US012807957B2

(12) United States Patent
Quick et al.

(10) Patent No.: US 12,807,957 B2
(45) Date of Patent: Nov. 24, 2026

(54) BISPECIFIC APTAMER COMPOSITIONS FOR THE TREATMENT OF RETINAL DISORDERS

(71) Applicant: Drive Therapeutics, L.L.C., Chapel Hill, NC (US)

(72) Inventors: Ryan Quick, Raleigh, NC (US); Matthew Levy, Chapel Hill, NC (US)

(73) Assignee: Drive Therapeutics, L.L.C., Chapel Hill, NC (US)

( * ) Notice: Subject to any disclaimer, the term of this patent is extended or adjusted under 35 U.S.C. 154(b) by 881 days.

(21) Appl. No.: 17/995,613

(22) PCT Filed: Apr. 6, 2021

(86) PCT No.: PCT/US2021/025964

§ 371 (c)(1),
(2) Date: Oct. 6, 2022

(87) PCT Pub. No.: WO2021/207197

PCT Pub. Date: Oct. 14, 2021

(65) Prior Publication Data

US 2024/0052353 A1 Feb. 15, 2024

Related U.S. Application Data

(60) Provisional application No. 63/005,629, filed on Apr. 6, 2020.

(51) Int. Cl.
*C12N 15/115* (2010.01)
*A61P 27/02* (2006.01)

(52) U.S. Cl.
CPC ............ *C12N 15/115* (2013.01); *A61P 27/02* (2018.01); *C12N 2310/16* (2013.01); *C12N 2310/321* (2013.01)

(58) Field of Classification Search
None
See application file for complete search history.

(56) References Cited

U.S. PATENT DOCUMENTS

2012/0141382 A1* 6/2012 Shi ..................... A61K 49/1809 977/773
2018/0293360 A1* 10/2018 Kelley ................... G16C 20/30
2019/0381088 A1* 12/2019 Haruta ................... A61K 47/60

FOREIGN PATENT DOCUMENTS

WO WO-2017094897 A1 * 6/2017 .............. A61P 37/02
WO 2017139417 A1 8/2017
WO WO-2019210097 A1 * 10/2019 ......... A61K 31/7115
WO 2019222344 A1 11/2019
WO 2020146801 A1 7/2020
WO 2020180842 A2 9/2020

OTHER PUBLICATIONS

Angelo et al. Clin Cancer Res 13, pp. 2825-2830 (Year: 2007).*
Shatunova et al. Biomedicines 8, 527, pp. 1-44 (Year: 2020).*
Supplementary European Search Report for European apln. No. EP 21784150, dated Jun. 20, 2025, 6 pages.
Ferguson, S., et al., "A bispecific aptamer targeting both VEGF and Angiopoietin-2 for treating retinal diseases | IOVS | ARVO Journals," ARVO Annual Meeting Abstract, Jul. 1, 2019, XP093074121, 2 pages.
Office Action for Japanese application No. JP2022-561633 mailed Apr. 30, 2025, 8 pages.
Notice of Reasons for Refusal in Japanese patent application No. 2022-561633 dated Feb. 3, 2026, 3 pages.
Search Report and Written Opinion in Singapore application No. 11202253850C, mailed Mar. 31, 2026, 8 pages.
Office Action issued in European Patent Application No. 21784150.1 dated Jan. 15, 2026, (5 pages).

* cited by examiner

*Primary Examiner* — Brian Whiteman
(74) *Attorney, Agent, or Firm* — Rothwell, Figg, Ernst & Manbeck, P.C.

(57) ABSTRACT

Disclosed herein are bispecific aptamers having affinity for multiple ligands and in particular, VEGF, IL8 and Ang2, as well as pharmaceutical compositions comprising the same. Methods of using some bispecific aptamers for the treatment of retinal diseases and disorders are also disclosed, as well as methods of making such bispecific aptamers and compositions.

15 Claims, 10 Drawing Sheets

Specification includes a Sequence Listing.

P = non-nucleotidyl linker

P = non-nucleotidyl linker

DL = duplex length = 3 to 25 nucleotides

X = any nucleotidyl linker, 0 to 25 nucleotides long
any non-nucleotidyl linker (e.g. PEG)

DL = duplex length = 3 to 25 nucleotides

X = any nucleotidyl linker, 0 to 25 nucleotides long
any non-nucleotidyl linker (e.g. PEG)

DL = duplex length = 3 to 25 nucleotides

X = any nucleotidyl linker, 0 to 25 nucleotides long
any non-nucleotidyl linker (e.g. PEG)

BISPECIFIC APTAMER COMPOSITIONS FOR THE TREATMENT OF RETINAL DISORDERS

CROSS-REFERENCE TO RELATED APPLICATIONS

This application is a 35 U.S.C. § 371 National Stage of International Patent Application No. PCT/US2021/025964, filed Apr. 6, 2021, claiming the benefit of provisional U.S. Application No. 63/005,629, filed Apr. 6, 2020. The entirety of these applications are hereby incorporated by reference for all purposes.

The instant application contains a Sequence Listing, which has been submitted via EFS-Web and is hereby incorporated by reference in its entirety. Said Sequence Listing, created on Jun. 2, 2026, is named "4790-107US2 ST25" and is 1,191,936 bytes in size.

FIELD OF THE INVENTION

Disclosed herein are bispecific aptamers, pharmaceutical compositions comprising the same as well as methods of treating retinal disorders with bispecific aptamers and pharmaceutical compositions. Methods of manufacturing such bispecific aptamers and pharmaceutical compositions are also disclosed.

BACKGROUND

Wet Age-Related Macular Degeneration (wAMD) affects more than 1.7 million Americans with about 200,000 new cases of wet AMD diagnosed each year (National Eye Institute). Anti-VEGF therapy (Lucentis®, Eylea®, Avastin®) is the standard of care and generally results in significant visual gains. Unfortunately, not all patients respond fully with as many as 25-75% of treated patients maintaining persistent retinal fluid (Wells et al. Ophthalmology 123, 1351-1359 (2016); Group, C. R., New England Journal of Medicine 364, 1897-1908 (2011); Heier et al. Ophthalmology 119, 2537-2548 (2012)). Persistent retinal fluid is associated with worse long-term visual outcomes compared to patients with dry/normal retinas (Sharma, S. et al. Ophthalmology 123, 865-875 (2016); Brown et al., Retina 33, 23-34 (2013)). For patients that respond well, treatment can be conducted at the prescribed dosing intervals (q4w, q8w or g12w depending on the drug) or "as needed" to improve or maintain visual gains. For patients that do not respond well, monthly dosing is required. For example, nearly one third of the patients in the HARBOR trial required near monthly dosing, a consequence of ≥5 letter decrease in vision, intraretinal fluid, subretinal fluid, or subretinal pigment epithelial fluid (Ho et al. Ophthalmology 121, 2181-2192 (2014)). For patients that don't fully respond (e.g., maintain fluid), the standard practice is currently to switch from one anti-VEGF therapy (usually Avastin® to start) to one of the alternatives (Lucentis® or Eylea®). In some instances, treatment dosing is increased to levels beyond what is prescribed. However, improvements gained with switching are usually minimal and are mostly anecdotal (Shah, C. P. Review of Ophthalmology (2018); You et al. Retina (Philadelphia, Pa.) 38, 1156 (2018)).

Diabetic Macular Edema (DME), which is a type of diabetic retinopathy (DR), affects more than 750,000 Americans and is a leading cause of vision loss for people with diabetes (Varma, R. et al. JAMA Ophthalmology 132, 1334-1340 (2014). Anti-VEGF therapies are only effective for ~30-40% of patients. For example, an analysis of data from the DRCR Network's Protocol I revealed only 40% of eyes showed improvement in best corrected visual acuity [BCVA](≥10 letters) by week 12 following 3 doses of Lucentis®. No further vision improvement was observed for most patients beyond what was observed in the initial 12 weeks even after a year of monthly dosing (Gonzalez, V. H. et al. American Journal of Ophthalmology 172, 72-79 (2016). Vascular and tissue inflammation contribute to DME, which is supported by studies correlating high levels of cytokines in the vitreous and aqueous humors of DME patients (Roh et al., Ophthalmology 116, 80-86 (2009); Funk, M. et al. Retina 30, 1412-1419 (2010); Feng, S. et al. Journal of Diabetes Research 2018 (2018); Jonas et al. Retina 32, 2150-2157 (2012)). Steroids (Ozurdex® and Iluvien®) are approved as second-line treatment alone or in combination with anti-VEGF therapy. However, the broad mechanism of action of these drugs leads to partial down-regulation of a host of different cytokines, chemokines and growth factors. This contributes to side effects such as increased ocular pressure and cataracts, which limits their use (Schwartz et al., Clinical Ophthalmology (Auckland, NZ) 10, 1723 (2016); Regillo, C. D. et al. Ophthalmic Surgery, Lasers and Imaging Retina 48, 291-301 (2017)).

The initial pivotal randomized controlled trials supported monthly dosing for Lucentis® and Avastin® and bimonthly dosing after 3-monthly doses for Eylea®. In order to mitigate the treatment burden of wAMD and DME, attention has been placed on researching the optimal dosing regimen for these medications. Anti-VEGF therapy has been administered at regularly spaced fixed intervals in 'continuous' regimens or at varying intervals in 'discontinuous' regimens in an attempt to reduce the burden, risks and costs of repeated intravitreal injections. These discontinuous regimens include a 'pro re nata' (PRN) approach based on findings of exudation, or a 'treat and extend' (T&E) approach that gradually increases assessment and treatment intervals after exudation is controlled. However, recent real-world data have shown that patients who receive a low number of annual injections achieve meaningfully worse visual acuity outcomes than those in pivotal trials.

Although anti-VEGF therapies have been effective and revolutionized the way retinal diseases are treated, a significant portion of patients do not respond to treatment or are undertreated due to the injection burden of current therapies and are left with inflammation, retinal fluid and edema. New approaches are needed to enhance efficacy, reduce treatment burden and improve patient care.

SUMMARY OF THE INVENTION

Disclosed herein are bispecific aptamers (e.g., RNA aptamers) that specifically bind to two or more target molecules (e.g., VEGF, IL8, Ang2 and combinations thereof), as well as pharmaceutical compositions comprising such bispecific aptamers. Also disclosed are methods of using such bispecific aptamers and pharmaceutical compositions for the treatment of ocular disease and disorders (e.g., retinal diseases and disorders), as well as methods of making such bispecific aptamers and pharmaceutical compositions.

In one aspect, a bispecific RNA aptamer is disclosed comprising Formula I:

$$X_1\text{-(aptamer 1)-}X_2\text{-(linker)-}Y_1\text{-(aptamer 2)-}Y_2\text{-invdT} \quad \text{Formula I}$$

wherein the bispecific aptamer comprises at least one nucleotide sequence shown in in Table A or at least one nucleotide sequences sharing at least about 70% identify with the nucleotide sequences shown in Table A.

In one embodiment, the aptamer and aptamer 2 each comprise a nucleotide sequence selected from SEQ ID Nos identified in Table 1 and sequences sharing at least about 70% identity with such SEQ ID Nos.

In a particular embodiment, the bispecific RNA aptamer has a hydrodynamic radius of about between about 9 and about 15 nm and more particularly, about 13.5 nm.

In a particular embodiment, aptamer 1 comprises a nucleotide sequence selected from SEQ ID. Nos.: 1-54. In a particular embodiment, aptamer 2 comprises a nucleotide sequence selected from SEQ ID. Nos.: 1-54.

In one embodiment, aptamer 1 and aptamer 2 are between about 30 and about 40 nucleotides in length.

In one embodiment, an inverted deoxythymidine (invdT) is incorporated at the 3'-end of the bispecific aptamer of Formula I, leading to the formation of a 3'-3' linkage which inhibits both degradation by 3' exonucleases and extension by DNA polymerases.

In another embodiment, the bispecific RNA aptamer specifically binds to VEGF or an isoform thereof (e.g., VEGF-A) and IL8 and inhibits the function thereof by between about 90% and about 100%, more particularly, about 90%, about 95%, about 98% or about 100%.

In a particular embodiment, the bispecific RNA aptamer binds to VEGF or an isoform thereof (e.g., VEGF-A) and IL8 with a binding affinity of between about 250 pM and about 20 pM, between about 500 nM and about 10 pM, or between about 750 nM and about 1 pM. In certain embodiments, the bispecific RNA aptamer has a binding affinity of about 250 nM, about 300 nM, about 350 nM, about 400 nM, about 450 nM, about 500 nM, about 550 nM, about 600 nM, about 650 nM, about 700 nM, about 750 nM or about 800 nM, about 850 nM, about 900 nM, about 950 nM or about 1 pM. In one embodiment, the bispecific RNA aptamer has a binding affinity less than about 20 pM, less than about 15 pM, less than about 10 pM, less than about 5 pM or about 1 pM or less.

In another embodiment the bispecific RNA aptamer specifically binds to VEGF or an isoform thereof (e.g., VEGF-A) and Ang2 and inhibits the function thereof by between about 90% and about 100%, more particularly, about 90%, about 95%, about 98% or about 100%.

In a particular embodiment, the bispecific RNA aptamer binds to VEGF or an isoform thereof (e.g., VEGF-a) and Ang2 with a binding affinity of about 250 pM and about 10 pM. In certain embodiments, the bispecific RNA aptamer has a binding affinity between about 500 nM and about 5 pM, or between about 750 nM and about 1 pM. In certain embodiments, the bispecific RNA aptamer has a binding affinity of about 250 nM, about 300 nM, about 350 nM, about 400 nM, about 450 nM, about 500 nM, about 550 nM, about 600 nM, about 650 nM, about 700 nM, about 750 nM or about 800 nM, about 850 nM, about 900 nM, about 950 nM or about 1 pM. In one embodiment, the bispecific RNA aptamer has a binding affinity less than about 10 pM, less than about 5 pM, or less than about 10 pM.

In a further embodiment, the bispecific RNA aptamer specifically binds to IL8 and Ang2 and inhibits the function thereof by between about 90% and about 100%, more particularly, about 90%, about 95%, about 98% or about 100%.

In a particular embodiment, the bispecific RNA aptamer binds to IL8 and Ang2 with a binding affinity of between about 20 pM and about 10 pM. In one embodiment, the bispecific aptamer has a binding affinity of about 20 pM, about 18 pM, about 15 pM, about 13 pM, about 10 pM, about 8 pM, about 5 pM, about 3 pM, or about Rogallo 1 pM.

In certain embodiments, $X_1$ comprises between 0-5 nucleotides, wherein the nucleotides are complementary to the nucleotides of $X_2$.

In certain embodiments, $Y_1$ comprises between 0-5 nucleotides that are complementary to the nucleotides of $Y_2$.

In one embodiment, the linker is a nucleotide linker comprising between 0 and 20 nucleotides.

In a particular embodiment, the linker is a nucleotide linker comprising one or more 2'OMe uridine residues.

In certain embodiments, the nucleotide linker comprises UUUUU, where U is 2'OMe.

In certain embodiments, the nucleotide linker comprises GCCGUGUUUUCACGGC (SEQ ID NO:443); where U, G, C and A are 2' OMe.

In a particular embodiment, the linker is a nucleotide linker comprising one or more 5 mU residues.

In certain embodiment, the linker is a non-nucleotide linker as shown in Table B.

In a particular embodiment, the linker is a heterobifunctional linker comprising a thiol reactive moiety (e.g., maleimide) and an amine reactive moiety.

In a particular embodiment, the linker is a non-nucleotide linker selected from the group consisting of 1,3-propanediol, 1,6 hexanediol, 1,12 dodecyldiol, triethylene glycol or hexaethylene glycol.

In one embodiment, aptamer A and aptamer B joined by hybridization.

In one embodiment, the bispecific RNA aptamer is modified with polyethylene glycol.

In certain embodiment, the polyethylene glycol is coupled to the bispecific aptamer.

In certain embodiments, the polyethylene glycol is coupled to a second linker, wherein the second linker is coupled to the bispecific aptamer.

In one embodiment, the bispecific RNA aptamer is modified with one or more additional therapeutic agents.

In certain embodiments, the bispecific RNA aptamer comprises one or more nucleotides that are chemically modified.

In a particular embodiment, the one or more chemically modified nucleotides are selected from the group consisting of 2'F Guanosine, 2' OMe Guanosine, 2'OMe Adenosine, 2'OMe Cytosine, 2'OMe Uridine and combinations thereof.

In certain embodiments, the one or more chemical modification(s) result in one or more improved characteristics selected from the group consisting of in vivo stability, stability against degradation, binding affinity for its target, and/or improved delivery characteristics in comparison to the same bispecific RNA aptamer having unmodified nucleotides.

In one embodiment, the one or more chemical modification results in an improvement in in vivo stability and more particularly, the half-life of the non-pegylated bispecific RNA aptamer is greater than about 10 hours or more particularly, greater than about 20 hours.

In certain embodiments, the half-life of the non-pegylated bispecific RNA aptamer is between about 10 and about 100 hours, more particularly, between about 300 and about 700 hours.

In certain embodiments, the half-life of the non-pegylated bispecific aptamer is between about 400 and about 700 hours, more particularly, between about 500 and about 600 hours and even more particularly, about 500, about 525, about 550, about 575, or about 600 hours.

In a particular embodiment, the one or more modifications enhance the affinity and specificity of the binding moiety for the target molecule compared to the bispecific RNA aptamer having a binding moiety with unmodified nucleotides.

In a particular embodiment, the one or chemical modifications provide additional charge, polarizability, hydrophobicity, hydrogen bonding, electrostatic interaction, and functionality to the bispecific aptamer.

In certain embodiments, the bispecific RNA aptamer comprises a VEGF Aptamer selected from the group consisting of Aptamer 285, Aptamer 481 and Aptamer 628 and an IL8 Aptamer selected from the group consisting of Aptamer 269 and Aptamer 248 and combinations thereof.

In certain embodiments, the bispecific RNA aptamer comprises VEGF Aptamer 285 and IL8 Aptamer 269.

In certain embodiments, the bispecific RNA aptamer comprises VEGF Aptamer 285 and aptamer 2 comprises IL8 Aptamer 248.

In certain embodiments, the bispecific RNA aptamer comprises VEGF Aptamer 481 and aptamer 2 comprises IL8 Aptamer 269.

In certain embodiments, the bispecific RNA aptamer comprises VEGF Aptamer 481 and aptamer 2 comprises IL8 Aptamer 248.

In certain embodiments, the bispecific RNA aptamer comprises VEGF Aptamer 628 and aptamer 2 comprises IL8 Aptamer 269.

In certain embodiments, the bispecific RNA aptamer comprises VEGF Aptamer 628 and aptamer 2 comprises IL8 Aptamer 248.

In certain embodiments, the bispecific RNA aptamer comprises a VEGF Aptamer selected from the group consisting of Aptamer 285, Aptamer 481 and Aptamer 628 and an IL8 Aptamer selected from the group consisting of Aptamer 269 and Aptamer 248 and combinations thereof linked by hybridization.

In certain embodiments, the bispecific RNA aptamer comprises a VEGF Aptamer selected from the group consisting of Aptamer 285, Aptamer 481 and Aptamer 628 and an IL8 Aptamer selected from the group consisting of Aptamer 269 and Aptamer 248 and combinations thereof linked by a non-nucleotide linker.

In certain embodiments, the bispecific aptamer comprises Aptamer 285 and Aptamer 269 linked by a non-nucleotide linker.

In a particular embodiment, the bispecific aptamer comprises Aptamer 285 and Aptamer 269 linked by hybridization.

In one embodiment, the bispecific RNA aptamer is associated with one or more additional molecules, which association may be covalent or non-covalent. In certain embodiments, the association comprises a linker.

In a particular embodiment, the one or more additional molecules is selected from the group consisting of antibodies, peptides, proteins, carbohydrates, enzymes, polymers, drugs, small molecules, gold nanoparticles, radiolabels, fluorescent labels, dyes, haptens, other aptamers, or nucleic acids.

In a particular embodiment, the one or more additional molecules is polyethylene glycol.

In a third aspect, a pharmaceutical composition is disclosed comprising the bispecific RNA aptamer disclosed herein and a pharmaceutically acceptable carrier.

In a particular embodiment, the pharmaceutical composition is formulated for intravitreal administration.

In a fourth aspect, a syringe is disclosed, wherein the syringe is pre-filed with the pharmaceutical composition disclosed herein.

In a fifth aspect, a method of modulating (e.g., inhibiting) the function of at least one target molecule is disclosed, comprising contacting the target molecule with the bispecific aptamer disclosed herein.

In a particular embodiment, the target molecule is selected from VEGF, IL8, Ang2 or a combination thereof.

In a sixth aspect, a method of treating a retinal disease or disorder is disclosed comprising administering an effective amount of the bispecific aptamer disclosed herein to a subject in need thereof, thereby treating the retinal disease or disorder.

In a particular embodiment, the retinal disease or disorder is the wet form of age-related macular degeneration (wAMD).

In a particular embodiment, the retinal disease or disorder is diabetic retinopathy.

In a particular embodiment, the diabetic retinopathy is diabetic macular edema.

In a particular embodiment, the retinal disease is retinal vein occlusion.

In a particular embodiment, the retinal vein occlusion is branched retinal vein occlusion.

In a particular embodiment, the retinal vein occlusion is central retinal vein occlusion.

In a particular embodiment, the retinal disease is retinopathy of prematurity.

In a particular embodiment, the retinal disease is radiation retinopathy.

In one embodiment, the subject in need thereof has been diagnosed with the retinal disease or disorder.

In a particular embodiment, the subject in need thereof has been previously treated with other anti-VEGF agent(s), but where the subject has shown a suboptimal response to such treatment.

In another embodiment, the subject in need thereof is at risk for the retinal disease or disorder.

In one embodiment, the administering is intraocular administration.

In a particular embodiment, the administering is by intravitreal injection.

In a particular embodiment, the intravitreal injection is part of kit containing a syringe that is prefilled with the bispecific composition.

In a particular embodiment, treatment results in an increase in overall best corrected visual acuity (BCVA) as measured on the Early Treatment Diabetic Retinopathy Study (ETDRS) chart by at least 3 letters, at least 4 letters, at least 5 letters, at least 6 letters, at least 7 letters, at least 8 letters, at least 9 letters, at least 10 letters, at least 11 letters, at least 12 letters, at least 13 letters, at least 14 letters, at least 15 letters, at least 16 letters, at least 17 letters, at least 18 letters, at least 19 letters, at least 20 letters, or more than 20 letters as compared to an untreated control subject over a defined period of time, selected from at least one of 2 weeks, one month, 2 months, 3 months, 6 months, one year, 2 years, or 5 years.

In one embodiment, treatment results in a percentage of patients gaining ≥15 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients gaining ≥10 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients gaining ≥5 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, treatment results in a reduction of retinal fluid as measured by fluorescein angiography (FA) and optical coherence tomography (OCT) of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, treatment results in a reduction of retinal thickness as measured by fluorescein angiography (FA) and optical coherence tomography (OCT) of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, treatment results in a reduction of the total area of choroidal neovascular (CNV) lesions as measured by fluorescein angiography (FA) and optical coherence tomography (OCT) of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years. In one embodiment, the method further comprises co-administering to the subject in need thereof at least one additional therapeutic modality, e.g., at least one additional therapeutic agent.

In a particular embodiment, the at least additional therapeutic agent is selected from Illuvien® and Ozurdex.®

In a seventh aspect, a method of treating a population of subjects in need thereof is provided, comprising administering an effective amount of the bispecific aptamer disclosed herein to such subjects.

In one embodiment, the method results in effective treatment for more than 30%, more than 35%, more than 40%, more than 45%, more than 50%, more than 55%, more than 60%, more than 65%, more than 70%, more than 75%, more than 80%, more than 85%, more than 90% or more than 95% of subjects treated. In a particular embodiment, effective treatment is measured by overall best corrected visual acuity (BCVA) as measured on the Early Treatment Diabetic Retinopathy Study (ETDRS).

In one embodiment, the method results in fewer than 30%, fewer than 25%, fewer than 20%, fewer than 15% or fewer than 10% of such subjects maintaining persistent retinal fluid.

In an eighth aspect, a method of making the bispecific RNA aptamer disclosed herein, comprising direct chemical synthesis, enzymatic synthesis, chemical synthesis followed by domain chemical conjugation, and/or domain hybridization.

In one embodiment, the bispecific aptamer is synthesized by direct chemical synthesis.

In one embodiment, the bispecific aptamer is synthesized by enzymatic synthesis.

In one embodiment, the bispecific aptamer is synthesized by chemical synthesis followed by domain chemical conjugation.

In one embodiment, the bispecific aptamer is synthesized by domain hybridization.

Figure 5A:
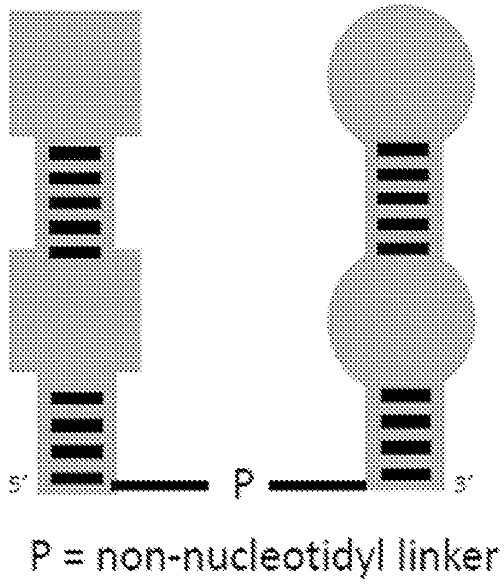

FIG. 5A: Depicts examples, approaches and parameters to link two aptamers by a non-nucleotide linker. Aptamer domains can be linked with the 3' end of the first aptamer attached to the 5' end of the second aptamer.

Figure 5B:
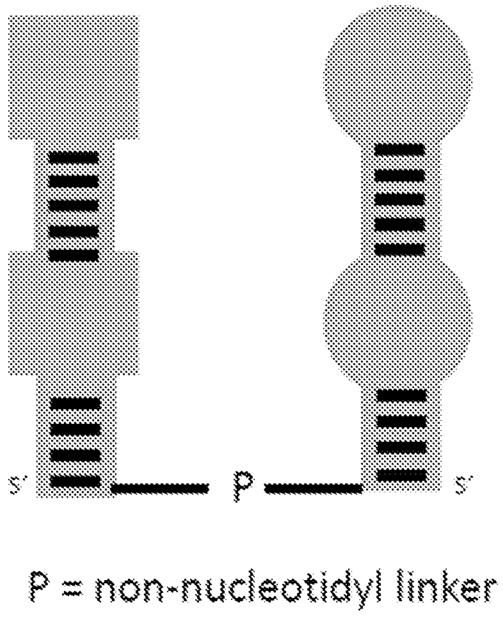

FIG. 5B Depicts examples, approaches and parameters to link two aptamers by a non-nucleotide linker. Aptamer domains can be linked with the 3' end of the first aptamer is attached to the 3' end of the second aptamer.

Figure 5C:
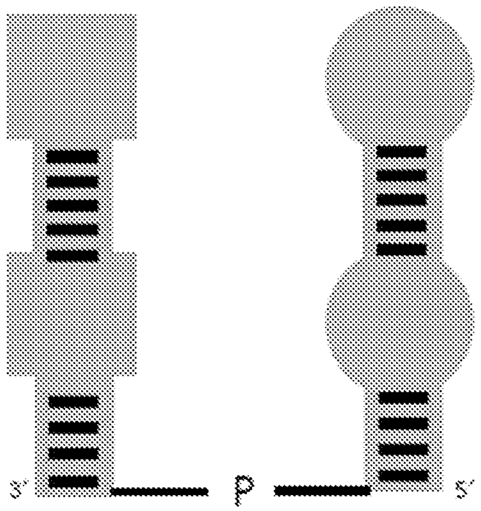

FIG. 5C Depicts examples, approaches and parameters to link two aptamers by a non-nucleotide linker. Aptamer domains can be linked with the 5' end of the first aptamer is attached to the 3' end of the second aptamer.

Figure 5D:
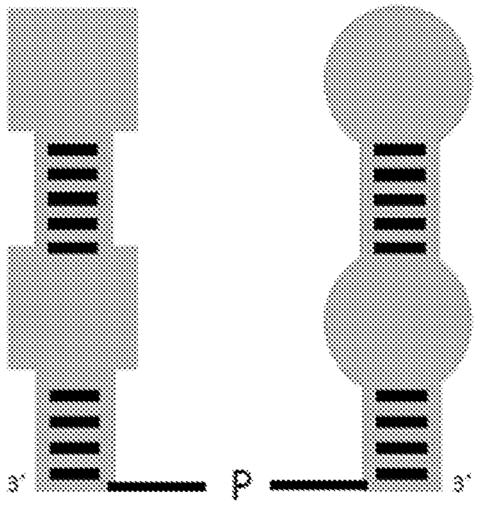

FIG. 5D Depicts examples, approaches and parameters to link two aptamers by a non-nucleotide linker. Aptamer domains can be linked with the 5' end of the first aptamer is attached to the 5' end of the second aptamer.

Figure 6:
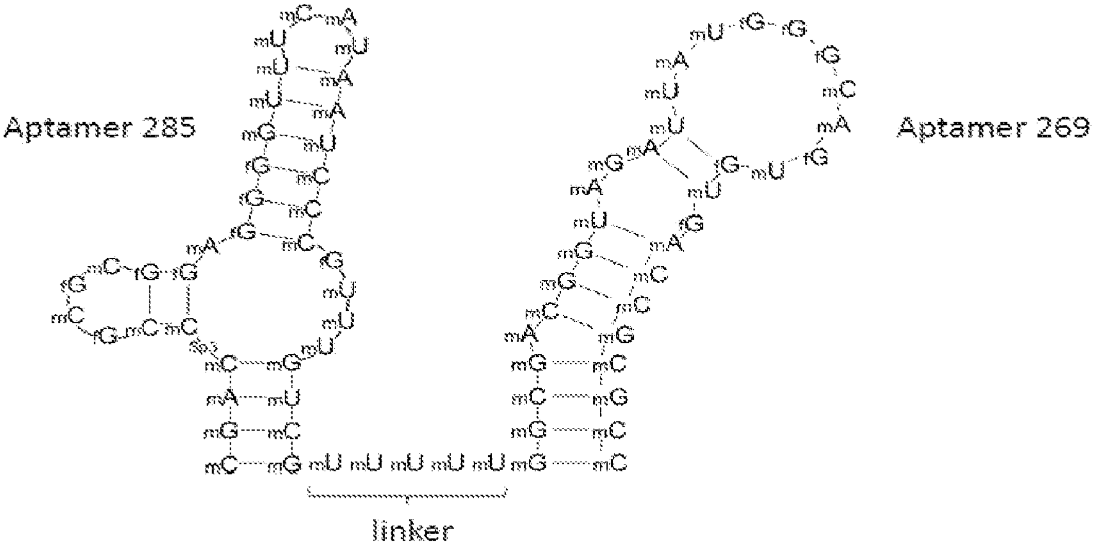

FIG. 6: Depicts an exemplary bispecific aptamer composed of Aptamer 285 and Aptamer 269 linked by a nucleotide linkage composed of five mU residues produced by direct chemical synthesis. mA, mC, mU and mG are 2'OMe RNA, fG is 2'F RNA and sp3 is a 1,3 propanediol linker (SEQ ID NO: 60).

Figure 7:
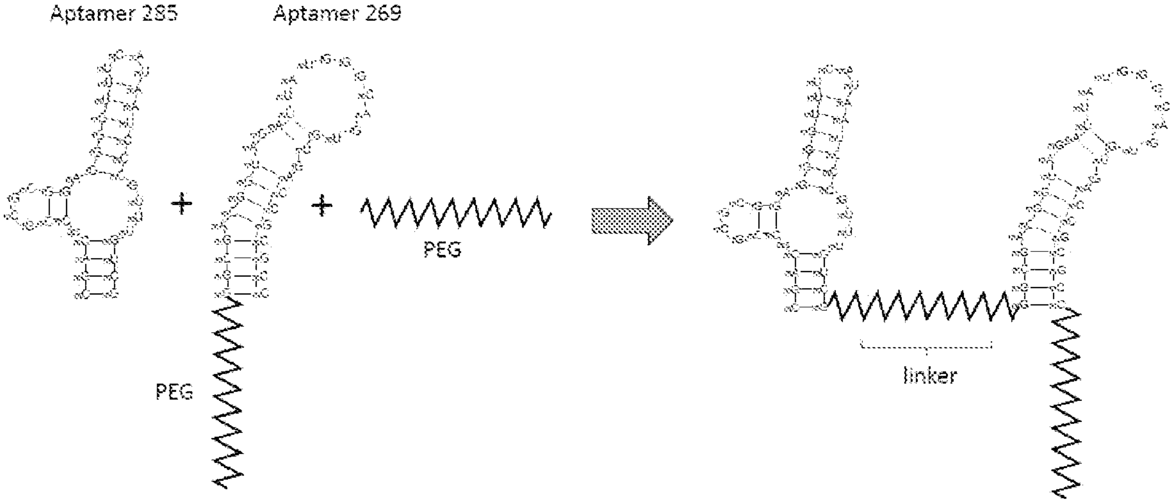

FIG. 7: Depicts an exemplary bispecific aptamer composed of aptamer 285 (SEQ ID NO: 1) and aptamer 269 (SEQ ID NO: 48) generated by post synthesis chemical conjugation. Depicted here, aptamer 285 and 269 are synthesized separately. Following synthesis aptamer 269 is PEGylated. Following PEGylation, the aptamers are chemically conjugated using a PEG linker. mA, mC, mU and mG are 2'OMe RNA, fG is 2'F RNA and sp3 is a 1,3 propanediol linker.

Figure 8A:
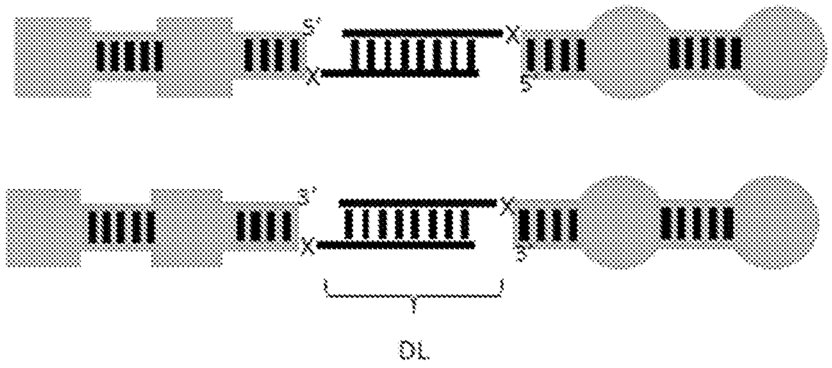

FIG. 8A: Depicts examples, approaches and parameters to link two aptamers by hybridization. Aptamer domains can be linked by hybridization in which the 3' end the first aptamer is extended and designed to hybridize and form a duplex with a 3' extension on the second aptamer. Or, aptamer domains can be linked by hybridization in which the 5' end the first aptamer is extended and designed to hybridize and form a duplex with a 5' extension on the second aptamer. The duplex length (DL) can vary between 3 and 35 nucleotides. The duplex may be separated from the aptamer by a nucleotidyl linker 0 to 25 nucleotides in length or a non-nucleotidyl linker.

Figure 8B:
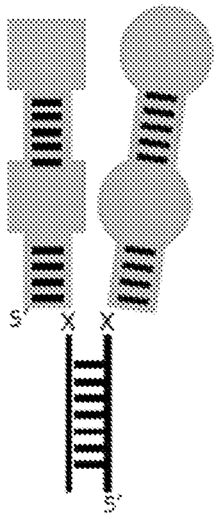

FIG. 8B Depicts examples, approaches and parameters to link two aptamers by hybridization. Aptamer domains can be linked by hybridization in which the 3' end the first aptamer is extended and designed to hybridize and form a duplex with a 5' extension on the second aptamer. The duplex length (DL) can vary between 3 and 35 nucleotides. The duplex may be separated from the aptamer by a nucleotidyl linker 0 to 25 nucleotides in length or a non-nucleotidyl linker.

Figure 8C:
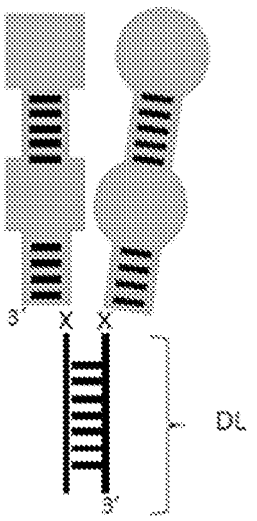

FIG. 8C Depicts examples, approaches and parameters to link two aptamers by hybridization. Aptamer domains can be linked by hybridization in which the 5' end the first aptamer is extended and designed to hybridize and form a duplex with a 3' extension on the second aptamer. The duplex length (DL) can vary between 3 and 35 nucleotides. The duplex may be separated from the aptamer by a nucleotidyl linker 0 to 25 nucleotides in length or a non-nucleotidyl linker.

Figure 9:
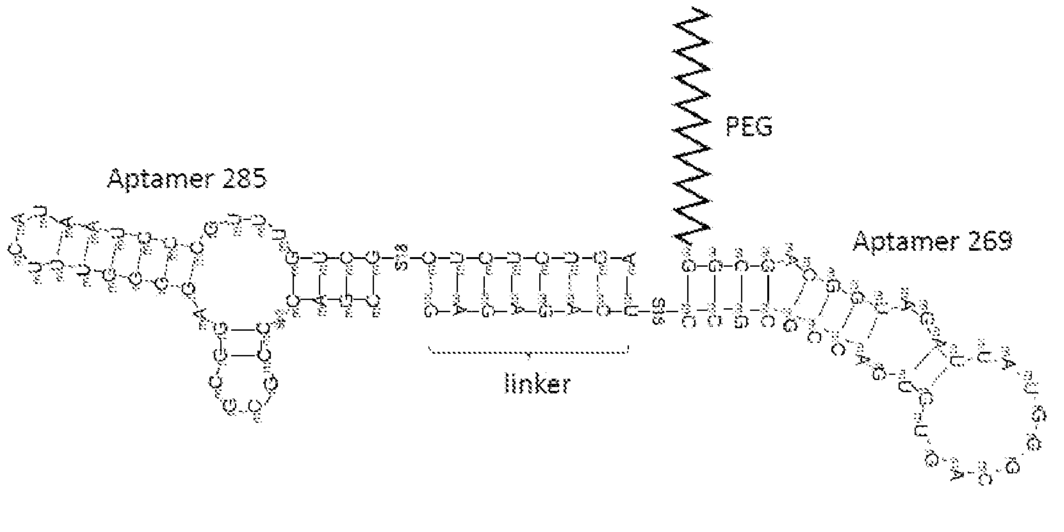

FIG. 9: Depicts an exemplary bispecific aptamer composed of Aptamer 285 (SEQ ID NO: 1) and Aptamer 269 (SEQ ID NO: 48) linked by hybridization. Depicted here, aptamer 285 and 269 are synthesized separately bearing a short 8 nucleotide complementary extension. The extension is linked to each aptamer at the 3' end by a hexaethylene glycol linker (S18). The 5' end of aptamer 269 is PEGylated. mA, mC, mU and mG are 2'OMe RNA, fG is 2'F RNA and sp3 is a 1,3 propanediol linker.

DETAILED DESCRIPTION

I. Definitions

The term "about" as used herein means a range of values including the specified value, which a person of ordinary skill in the art would consider reasonably similar to the specified value. In embodiments, the term "about" means within a standard deviation using measurements generally acceptable in the art. In embodiments, about means a range extending to +/−10% of the specified value. In embodiments, about means the specified value.

The terms "administering" or "administration" as used herein generally refer to introducing a therapeutic agent, composition, formulation, etc., to a desired site or location on or within the body of a subject, e.g., a site or location within the eye. Administration may be performed, e.g., by a health care provider. For purposes of convenience, the present specification refers generally to ophthalmologists. However, the methods described herein, including both the methods of the invention and other methods (e.g., methods for diagnosing and/or monitoring a retinal disorder) may be practiced by any qualified health care provider.

The term "affinity" as used herein refers to the strength of the sum total of noncovalent interactions between a single binding site of a molecule (e.g., an aptamer) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant (Kd). As used herein the term "high affinity" means less than 500 nM.

The term "antigen" as used herein refers to the binding site or epitope recognized by an antigen-binding aptamer. The term "aptamer" as used herein refers to a peptide or nucleic acid molecule, such as RNA or DNA that is capable of binding to a specific molecule with high affinity and specificity. Exemplary ligands that bind to an aptamer include, without limitation, small molecules, such as drugs, metabolites, intermediates, cofactors, transition state analogs, ions, metals, nucleic acids, and toxins, such as endotoxins. Aptamers may also bind natural and synthetic polymers, including proteins, peptides, nucleic acids, polysaccharides, glycoproteins, hormones, receptors and cell surfaces such as cell walls and cell membranes. The binding of a ligand to an aptamer, causes a conformational change in the effector domain and alters its ability to interact with its target molecule. An aptamer will most typically have been obtained by in vitro selection for binding of a target molecule. However, in vivo selection of an aptamer is also possible. Aptamers have specific binding regions which are capable of forming complexes with an intended target molecule in an environment, wherein other substances in the same environment are not complexed to the nucleic acid. The specificity of the binding is defined in terms of the comparative dissociation constants (Kd) of the aptamer for its ligand as compared to the dissociation constant of the aptamer for other materials in the environment or unrelated molecules in general. A ligand is one which binds to the aptamer with greater affinity than to unrelated material. Typically, the Kd for the aptamer with respect to its ligand will be at least about 10-fold less than the Kd for the aptamer with unrelated material or accompanying material in the environment. Even more preferably, the Kd will be at least about 50-fold less, more preferably at least 50 about 100-fold less, and most preferably at least about 200-fold less. An aptamer will typically be between about 10 and about 300 nucleotides in length. More commonly, an aptamer will be between about 30 and about 100 nucleotides in length.

The term "aptamer domain" as used herein refers to refers to a nucleic acid element or domain within a nucleic acid sequence or polynucleotide sequence that, at a biophysically effective amount, will bind or have an affinity for one or a plurality of target molecules.

The term "bispecific aptamer" as used herein refers to an aptamer that binds two distinct antigens or two distinct epitopes within the same antigen. The bispecific aptamer may have cross-reactivity to other related antigens, for example to the same antigen from other species (homologs).

The term "carrier" as used herein refers to compound, composition, substance, or structure that, when in combination with a compound or composition, aids or facilitates preparation, storage, administration, delivery, effectiveness, selectivity, or any other feature of the compound or composition for its intended use or purpose. For example, a carrier can be selected to minimize any degradation of the active ingredient and to minimize any adverse side effects in the subject.

The term "co-administration" as used herein refers to administration of the bispecific aptamer described herein to a subject simultaneously or consecutively with one or more additional therapeutic agents. In a particular embodiment, the one or more additional therapeutic agents include steroids such as Illuvien® and Ozurdex®. In a particular embodiment, the one or more additional therapeutic agents include a Complement Factor 3 (C3) or Complement Factor 5 (C5) inhibitor for the treatment of geographic atrophy and the dry form of advanced macular degeneration. In one embodiment, the C3 inhibitor is APL-2 (Apellis Pharmaceuticals). In one embodiment, the C5 inhibitor is Zimura® (Iveric Bio).

The terms "complementary" or "complementarity" refer to the ability of a nucleic acid in a polynucleotide to form a base pair with another nucleic acid in a second polynucleotide. For example, the sequence A-G-T is complementary to the sequence T-C-A. Complementarity may be partial, in which only some of the nucleic acids match according to base pairing, or complete, where all the nucleic acids match according to base pairing.

The term "conjugation" as used herein refers to a chemical compound that is formed by joining two or more compounds with one or more chemical bonds or linkers. In an embodiment disclosed herein, a bispecific aptamer is conjugated to a lipid or high molecular weight compound (e.g., PEG), and/or another therapeutic agent.

The term "DNA" means deoxyribonucleic acid.

The terms "effective amount" and "therapeutically effective amount," are used herein interchangeably to refer to a sufficient amount of an agent or a composition or combination of compositions being administered which will relieve to some extent one or more of the symptoms of the disease or condition being treated. The result can be reduction and/or alleviation of the signs, symptoms, or causes of a disease, or any other desired alteration of a biological system. For example, an "effective amount" for therapeutic uses is the amount of the composition as disclosed herein required to provide a clinically significant decrease in disease symptoms. An appropriate "effective" amount in any individual case may be determined using techniques, such as a dose escalation study. The dose could be administered in one or more administrations. However, the precise determination of what would be considered an effective dose may be based on factors individual to each patient, including, but not limited to, the patient's age, size, type or extent of disease, stage of the disease, route of administration, the type or extent of supplemental therapy used, ongoing disease process and type of treatment desired (e.g., aggressive vs. conventional treatment).

The term "epitope" as used herein refers to the part of an antigen (e.g., a substance that stimulates an immune system to generate an antibody against) that is specifically recognized by the antibody. In certain embodiments, the antigen is a protein or peptide and the epitope is a specific region of the protein or peptide that is recognized and bound by an antibody.

The term "hydrodynamic radius" or "$R_h$" as used herein refers to the radius of an equivalent hard-sphere diffusing at the same rate as the molecule under observation. In certain embodiments, the bispecific aptamers disclosed herein have a hydrodynamic radius that is about 50% greater than aptamers known in the art and more particularly, about 9, about 10, about 11, about 12, about 13, about 14 or about 15 $R_h$. In certain embodiments, a bispecific RNA aptamer is disclosed that has a hydrodynamic radius of between about 12 and about 14, and more particularly about 13, about 13.5 or about 14 $R_h$. In certain embodiments, this $R_h$ is measured before pegylation of the bispecific aptamer, wherein pegylation would further increase the hydrodynamic radius, e.g., by about 1, about 2, about 3, about 4 or about 5 $R_h$ or more over the non-pegylated bispecific aptamer.

The terms "identical" or percent "identity," in the context of two or more nucleic acids or polypeptide sequences, refer to two or more sequences or subsequences that are the same or have a specified percentage of amino acid residues or nucleotides that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection (see, e.g., NCBI web site ncbi.nlm.nih.gov/BLAST/or the like). Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length.

The term "isolated" as used herein with reference to a nucleic acid or protein, indicates that the nucleic acid or protein or peptide is essentially free of other cellular components with which it is associated in the natural state. It can be, for example, in a homogeneous state and may be in either a dry or aqueous solution. Purity and homogeneity are typically determined using analytical chemistry techniques such as polyacrylamide gel electrophoresis or high-performance liquid chromatography (HPLC). A protein or peptide that is the predominant species present in a preparation is substantially purified.

The term "linker" as used herein refers to molecule positioned between two moieties. Typically, linkers are bifunctional, i.e., the linker includes a functional group at each end, wherein the functional groups are used to couple the linker to the two moieties.

The term "nucleic acid" as used herein refers to deoxyribonucleotides or ribonucleotides and polymers thereof in either single-, double- or multiple-stranded form, or complements thereof. The term "polynucleotide" refers to a linear sequence of nucleotides. The term "nucleotide" typically refers to a single unit of a polynucleotide, i.e., a monomer. Nucleotides can be ribonucleotides, deoxyribonucleotides, or modified versions thereof. Examples of polynucleotides contemplated herein include single and double stranded DNA, single and double stranded RNA (including siRNA), and hybrid molecules having mixtures of single and double stranded DNA and RNA. Nucleic acids can be linear or branched. For example, nucleic acids can be a linear chain of nucleotides or the nucleic acids can be branched, e.g., such that the nucleic acids comprise one or more arms or branches of nucleotides. Optionally, the branched nucleic acids are repetitively branched to form higher ordered structures such as dendrimers and the like.

The term "nucleotide linker" as used herein refers to oligonucleotide that connects an aptamer to another aptamer. In contrast a "non-nucleotide linker" refers to a linker that does not include nucleotides or nucleotide analogs. Without limitations, the nucleotide linker can be single-stranded or a double-stranded oligonucleotide, e.g., a linker comprising a first oligonucleotide strand and second oligonucleotide strand, wherein the first and the second strands are sufficiently complementary to each other. Furthermore, the nucleotide linker can comprise one or more of the nucleotide modifications described herein. A nucleotide linker can be of any length, e.g., between 4-30 nucleotides in length.

The term "pegylated compound" as used herein refers to a compound (e.g., an aptamer) with one or more polyethylene glycol moieties. In certain embodiments disclosed herein, the aptamer or bispecific aptamer is a pegylated compound.

The terms "peptide" and "protein" are used interchangeably herein to refer to polymers of amino acids of any length. A polypeptide can be any protein, peptide, protein fragment or component thereof. A polypeptide can be a protein naturally occurring in nature or a protein that is ordinarily not found in nature. A polypeptide can consist largely of the standard twenty protein-building amino acids or it can be modified to incorporate non-standard amino acids. A polypeptide can be modified, typically by the host cell, by e.g., adding any number of biochemical functional groups, including phosphorylation, acetylation, acylation, formylation, alkylation, methylation, lipid addition (e.g., palmitoylation, myristoylation, prenylation, etc.) and carbohydrate addition (e.g., N-linked and O-linked glycosylation, etc.). Polypeptides can undergo structural changes in the host cell such as the formation of disulfide bridges or proteolytic cleavage. The peptides described herein may be therapeutic peptides utilized for e.g., the treatment of a disease.

The term "pharmaceutical composition" as used herein refers to compositions that include an amount (for example, a unit dosage) of one or more of the disclosed bi-specific aptamers together with one or more non-toxic pharmaceutically acceptable additives, including carriers, diluents, and/or adjuvants, and optionally other biologically active ingredients.

The term "pharmaceutically acceptable" as used herein refers to those compounds, materials, compositions, and/or dosage forms which are, within the scope of sound medical judgment, suitable for use in contact with the tissues of human beings and animals without excessive toxicity, irritation, allergic response, or other problems or complications commensurate with a reasonable benefit/risk ratio.

The term "purified" as used herein refers to a peptide that gives rise to essentially one band in an electrophoretic gel. In some embodiments, the peptide is at least 50% pure, optionally at least 65% pure, optionally at least 75% pure, optionally at least 85% pure, optionally at least 95% pure, and optionally at least 99% pure.

The term "reduces" or "inhibits" are used interchangeably herein to refer to a negative alteration of at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, or at least 100% or more.

The term "retinal disease" and "retinal disorder" are used interchangeably herein and refers to any disease or disorder in which the retina is affected due to multiple and variant etiologies.

The term "RNA" refers to ribonucleic acid.

The term "SELEX" as used herein refers to Systematic evolution of ligands by exponential enrichment and is a combination of (1) the selection of aptamers that interact with a target molecule in a desirable manner, for example binding with high affinity to a protein, with (2) the amplification of those selected nucleic acids. The SELEX™ process can be used to identify aptamers with high affinity to a specific target or biomarker.

The term "specifically binds" as used herein refers to the ability of an aptamer to bind to an antigen with an Kd of at least about 1 micromolar down to 1 picomolar and/or bind to an antigen with an affinity that is at least two-fold greater than its affinity for a nonspecific antigen. It shall be understood, however, that the bispecific aptamers disclosed herein are capable of specifically binding to two or more antigens which are related in sequence. For example, the bispecific aptamers disclosed herein can specifically bind to both a human antigen and a non-human ortholog of that antigen.

The terms "subject" and "patient" are used interchangeably herein to refer to a vertebrate, preferably a mammal, more preferably a human. Mammals include, but are not limited to, murines, simians, humans, farm animals, sport animals, and pets. Tissues, cells, and their progeny of a biological entity obtained in vivo or cultured in vitro are also encompassed.

The term "substantially homologous" or "substantially identical" in the context of two or more oligonucleotides, nucleic acids, or aptamers, generally refers to two or more sequences or subsequences that have at least 40%, 60%, 80%, 90%, 95%, 96%, 97%, 98% or 99% nucleotide identity, when compared and aligned for maximum correspondence, as measured using sequence comparison algorithms or by visual inspection.

The term "unit dosage form" as used herein refers to physically discrete units suited as unitary dosages for the subject to be treated (e.g., for a single eye); each unit containing a predetermined quantity of an active agent selected to produce the desired therapeutic effect, optionally together with a pharmaceutically acceptable carrier, which may be provided in a predetermined amount. The unit dosage form may be, for example, a volume of liquid (e.g., a pharmaceutically acceptable carrier) containing a predetermined quantity of a therapeutic agent, a predetermined amount of a therapeutic agent in solid form, an ocular implant containing a predetermined amount of a therapeutic agent, a plurality of nanoparticles or microparticles that collectively contain a predetermined amount of a therapeutic agent, etc. It will be appreciated that a unit dosage form may contain a variety of components in addition to the therapeutic agent. For example, pharmaceutically acceptable carriers, diluents, stabilizers, buffers, preservatives, etc., may be included. In certain embodiments, the aptamer or bispecific aptamer disclosed herein is provided in a unit dosage form.

The term "target molecule" or "target" are used interchangeably herein to refer any molecule of interest. The term includes any minor variation of a particular molecule, such as, in the case of a protein, for example, minor variations in amino acid sequence, disulfide bond formation, glycosylation, lipidation, acetylation, phosphorylation, or any other manipulation or modification, such as conjugation with a labeling component, which does not substantially alter the identity of the molecule. A "target molecule", "target", or "analyte" refers to a set of copies of one type or species of molecule or multi-molecular structure. "Target molecules", "targets", and "analytes" refer to more than one type or species of molecule or multi-molecular structure. Exemplary target molecules include proteins, polypeptides, nucleic acids, carbohydrates, lipids, polysaccharides, glycoproteins, hormones, receptors, antigens, antibodies, affibodies, antibody mimics, viruses, pathogens, toxic substances, substrates, metabolites, transition state analogs, cofactors, inhibitors, drugs, dyes, nutrients, growth factors, cells, tissues, and any fragment or portion of any of the foregoing. In some embodiments, a target molecule is a protein, in which case the target molecule may be referred to as a "target protein."

The term "treatment or treating" as used herein means an approach for obtaining beneficial or desired results, including clinical results. Beneficial or desired clinical results can include, but are not limited to, alleviation or amelioration of one or more symptoms or conditions, diminishment of extent of disease, stabilized (i.e., not worsening) state of disease, preventing spread of disease, delay or slowing of disease progression, amelioration or palliation of the disease state, and remission (whether partial or total), whether detectable or undetectable.

The term "variant" as used herein with respect to a peptide, refers to a peptide in which an, insertion, deletion, addition and/or substitution has occurred in at least one amino acid residue relative to the reference peptide. The variant may be approximately 99%, 98%, 97%, 96%, 95%, 94%, 93%, 92%, 91%, 90%, 89%, 88%, 87%, 86%, 85%, 84%, 83%, 82%, 81% or 80% sequence of the aptamer or aptamer domain.

The terms "vascular endothelial growth factor", and "VEGF" as used herein refer to naturally-occurring VEGF, including isoforms and variants thereof. As used herein, VEGF includes all mammalian species of VEGF, including but not limited to human, canine, feline, murine, primate, equine, and bovine VEGF.

II. Bispecific Aptamer Compositions

In one aspect, a bispecific aptamer is disclosed comprising Formula A:

(aptamer1)-(linker)-(aptamer2) Formula A

In one embodiment, the bispecific aptamer is a DNA aptamer. In another embodiment, the bispecific aptamer is an RNA aptamer.

In a particular embodiment, the bispecific aptamer is an RNA aptamer wherein the sequence identities of (aptamer 1) and (aptamer 2) are indicated in Table 1.

In certain embodiments, the positions of (aptamer 1) and (aptamer 2) can be exchanged.

In certain embodiments, the linker is a nucleotide linker having between 0 and 20 nucleotides.

In certain embodiments, the linker is a non-nucleotide linker selected from the group consisting of 1,3-propanediol, 1,6 hexanediol, 1,12 dodecyldiol, triethylene glycol or hexaethylene glycol.

In certain embodiments, aptamer 1 or aptamer 2 is an aptamer that binds to vascular endothelial growth factor A (VEGF-A) selected from the group consisting of SEQ ID NOS: 1-46.

In certain embodiments, aptamer 1 or aptamer 2 is an aptamer that binds to interleukin 8 (IL8) selected from the group consisting of SEQ ID NOS: 47-48.

In certain embodiments, aptamer 1 or aptamer 2 is an aptamer that binds to angiopoietin 2 (ANG2) selected from the group consisting of SEQ ID NOS: 49-50.

In certain embodiments, aptamer 1 or aptamer 2 is an aptamer that binds to complement component 5 (C5) comprising SEQ ID NO: 51.

In certain embodiments, aptamer 1 or aptamer 2 is an aptamer that binds to platelet-derived growth factor (PDGF) comprising SEQ ID NO: 52.

In certain embodiments, aptamer 1 or aptamer 2 is an aptamer that binds to fibroblast growth factor (FGF) comprising SEQ ID NO: 53.

In certain embodiments, aptamer 1 or aptamer 2 is an aptamer that binds to Factor D comprising SEQ ID NO: 54.

In one aspect, a bispecific aptamer is disclosed comprising Formula II:

$X_1$-(aptamer 1)-$X_2$-(linker)-$Y_1$-(aptamer 2)-$Y_2$-invdT Formula I

In certain embodiments, the sequence identities of (aptamer 1) and (aptamer 2) are indicated in Table 1.

In certain embodiments, the positions of (aptamer 1) and (aptamer 2) can be exchanged.

In certain embodiments, $X_1$ is 0-5 nucleotides in length that are designed to base pair with region $X_2$.

In certain embodiments, $Y_1$ is 0-5 nucleotides in length that are designed to base pair with region $Y_2$.

In certain embodiments, the linker is a nucleotide linker having between 0 and 20 nucleotides.

In certain embodiments, the linker is a non-nucleotide linker selected from the group consisting of 1,3-propanediol, 1,6 hexanediol, 1,12 dodecyldiol, triethylene glycol or hexaethylene glycol.

In one embodiment, an inverted deoxythymidine (invdT) is incorporated at the 3'-end of the bispecific aptamer of Formula I, leading to the formation of a 3'-3' linkage which inhibits both degradation by 3' exonucleases and extension by DNA polymerases.

In certain embodiments, aptamer 1 or aptamer 2 is an aptamer that binds to vascular endothelial growth factor A (VEGF-A) selected from the group consisting of SEQ ID NOS: 1-46.

In certain embodiments, aptamer 1 or aptamer 2 is an aptamer that binds to interleukin 8 (IL8) selected from the group consisting of SEQ ID NOS: 47-48.

In certain embodiments, aptamer 1 or aptamer 2 is an aptamer that binds to angiopoietin 2 (ANG2) selected from the group consisting of SEQ ID NOS: 49-50.

In certain embodiments, aptamer 1 or aptamer 2 is an aptamer that binds to complement component 5 (C5) comprising SEQ ID NO: 51.

In certain embodiments, aptamer 1 or aptamer 2 is an aptamer that binds to platelet-derived growth factor (PDGF) comprising SEQ ID NO: 52.

In certain embodiments, aptamer 1 or aptamer 2 is an aptamer that binds to fibroblast growth factor 2 (FGF2) comprising SEQ ID NO: 53.

In certain embodiments, aptamer 1 or aptamer 2 is an aptamer that binds to Factor D comprising SEQ ID NO: 54.

In another aspect, a bispecific aptamer is disclosed comprising Formula III:

$$5'\text{-}X_1\text{-(aptamer1)-}X_2\text{-(linker)-(Hyb1)(Hyb2)-(linker)-}Y_2\text{-(aptamer 2)-}Y_1\text{-}5' \quad \text{Formula II}$$

wherein Hyb1 and Hyb2 are complementary.

In certain embodiments, the sequence identities of (aptamer 1) and (aptamer 2) are indicated in Table 1.

In certain embodiments, the positions of (aptamer 1) and (aptamer 2) can be exchanged.

In certain embodiments, $X_1$ is 0-5 nucleotides in length that are designed to base pair with region $X_2$.

In certain embodiments, $Y_1$ is 0-5 nucleotides in length that are designed to base pair with region $Y_2$.

In certain embodiments, the linker is a nucleotide linker having between 0 and 20 nucleotides.

In certain embodiments, the linker is a non-nucleotide linker selected from the group consisting of 1,3-propanediol, 1,6 hexanediol, 1,12 dodecyldiol, triethylene glycol or hexaethylene glycol.

In certain embodiments, aptamer 1 or aptamer 2 is an aptamer that binds to vascular endothelial growth factor A (VEGF-A) selected from the group consisting of SEQ ID NOS: 1-46.

In certain embodiments, aptamer 1 or aptamer 2 is an aptamer that binds to interleukin 8 (IL8) selected from the group consisting of SEQ ID NOS: 47-48.

In certain embodiments, aptamer 1 or aptamer 2 is an aptamer that binds to angiopoietin 2 (ANG2) selected from the group consisting of SEQ ID NOS: 49-50.

In certain embodiments, aptamer 1 or aptamer 2 is an aptamer that binds to complement component 5 (C5) comprising SEQ ID NO: 51.

In certain embodiments, aptamer 1 or aptamer 2 is an aptamer that binds to platelet-derived growth factor (PDGF) comprising SEQ ID NO: 52.

In certain embodiments, aptamer 1 or aptamer 2 is an aptamer that binds to fibroblast growth factor (FGF) comprising SEQ ID NO: 53.

In certain embodiments, aptamer 1 or aptamer 2 is an aptamer that binds to Factor D comprising SEQ ID NO: 54.

In certain embodiments, the bispecific RNA aptamer comprises a VEGF Aptamer selected from the group consisting of Aptamer 285, Aptamer 481 and Aptamer 628 and an IL8 Aptamer selected from the group consisting of Aptamer 269 and Aptamer 248 and combinations thereof.

In certain embodiments, the bispecific RNA aptamer comprises VEGF Aptamer 285 and IL8 Aptamer 269.

In certain embodiments, the bispecific RNA aptamer comprises VEGF Aptamer 285 and aptamer 2 comprises IL8 Aptamer 248.

In certain embodiments, the bispecific RNA aptamer comprises VEGF Aptamer 481 and aptamer 2 comprises IL8 Aptamer 269.

In certain embodiments, the bispecific RNA aptamer comprises VEGF Aptamer 481 and aptamer 2 comprises IL8 Aptamer 248.

In certain embodiments, the bispecific RNA aptamer comprises VEGF Aptamer 628 and aptamer 2 comprises IL8 Aptamer 269.

In certain embodiments, the bispecific RNA aptamer comprises VEGF Aptamer 628 and aptamer 2 comprises IL8 Aptamer 248.

In certain embodiments, the bispecific RNA aptamer comprises a VEGF Aptamer selected from the group consisting of Aptamer 285, Aptamer 481 and Aptamer 628 and an IL8 Aptamer selected from the group consisting of Aptamer 269 and Aptamer 248 and combinations thereof linked by hybridization.

In certain embodiments, the bispecific RNA aptamer comprises a VEGF Aptamer selected from the group consisting of Aptamer 285, Aptamer 481 and Aptamer 628 and an IL8 Aptamer selected from the group consisting of Aptamer 269 and Aptamer 248 and combinations thereof linked by a non-nucleotide linker.

In a particular embodiment of Formula III, the bispecific RNA aptamer further comprises between 3-25 nucleotides with complementary sequences that allow for the first and second aptamers to hybridize. In one embodiment, the complementary sequences are separated from the aptamer by a linker.

In one aspect, a bispecific aptamer having a hydrodynamic radius of about 9 or more, 10 or more Rh, about 11 or more Rh, about 12 or more Rh, about 13 or more Rh, about 14 or more Rh or about 15 or more Rh, and capable of binding to a target molecule selected from the group consisting of VEGF or isoforms thereof, IL8 or Ang2. Optionally, the bispecific aptamer is an RNA aptamer having at least one sequence disclosed in Table 1, herein.

TABLE 1

| SEQ ID NO: | Aptamer | Target | Sequence |
|---|---|---|---|
| 1 | 285 | VEGF | CXACZCCGCGCGGAGGGXUUUCAUAAUCCCGUUUXUCX |
| 2 | 26 | VEGF | AGGCCGCCUCCGCGCGGAGGGGUUUCAUUAUCCCGUUUGGCGGCUU |
| 3 | 439 | VEGF | CGACUCCGCGCGGAGGGUUGGAGGUUACCCGUUUGUCG |
| 4 | 441 | VEGF | CGACUCCGCGCGGAGUCCCUAAUUUGGGGCGUUUGUCG |
| 5 | 443 | VEGF | CGACUCCGCGCGGAGUCCCUUCAUUGGGGCGUUUGUCG |

TABLE 1-continued

| SEQ ID NO: | Aptamer | Target | Sequence |
|---|---|---|---|
| 6 | 445 | VEGF | CGACUCCGCGCGGAGGGUUAAUGGCUACCCGUUUGUCG |
| 7 | 447 | VEGF | CGACUCCGCGCGGAGUCCCUGUAAUGGGGCGUUUGUCG |
| 8 | 479 | VEGF | CGACUCCGCGCGGAGGGUUUGGCUACCCGUUUGUCG |
| 9 | 481 | VEGF | CGACUCCGCGCGGAGGCUUGAGGUAGCCGUUUGUCG |
| 10 | 483 | VEGF | CGACUCCGCGCGGAGUCCCACAUGGGGCGUUUGUCG |
| 11 | 485 | VEGF | CGACUCCGCGCGGAGGGAUGAGGUUCCCGUUUGUCG |
| 12 | 487 | VEGF | CGACUCCGCGCGGAGGCAUGAGGUUGCCGUUUGUCG |
| 13 | 489 | VEGF | CGACUCCGCGCGGAGUGCUGAGGUGCACGUUUGUCG |
| 14 | 600 | VEGF | CGACZCCGCGCGGAGGGUUGGAGGUUACCCGUUUGUCG |
| 15 | 601 | VEGF | CGACZCCGCGCGGAGUCCCUAAUUUGGGGCGUUUGUCG |
| 16 | 602 | VEGF | CGACZCCGCGCGGAGUCCCUUCAUUGGGGCGUUUGUCG |
| 17 | 603 | VEGF | CGACZCCGCGCGGAGGGUUAAUGGCUACCCGUUUGUCG |
| 18 | 604 | VEGF | CGACZCCGCGCGGAGUCCCUGUAAUGGGGCGUUUGUCG |
| 19 | 605 | VEGF | CGACZCCGCGCGGAGGGUUUGGCUACCCGUUUGUCG |
| 20 | 606 | VEGF | CGACZCCGCGCGGAGGCUUGAGGUAGCCGUUUGUCG |
| 21 | 607 | VEGF | CGACZCCGCGCGGAGUCCCACAUGGGGCGUUUGUCG |
| 22 | 608 | VEGF | CGACZCCGCGCGGAGGGAUGAGGUUCCCGUUUGUCG |
| 23 | 609 | VEGF | CGACZCCGCGCGGAGGCAUGAGGUUGCCGUUUGUCG |
| 24 | 610 | VEGF | CGACZCCGCGCGGAGUGCUGAGGUGCACGUUUGUCG |
| 25 | 611 | VEGF | CXACUCCGCGCGGAGGGUUGGAGGUUACCCGUUUXUCX |
| 26 | 612 | VEGF | CXACUCCGCGCGGAGUCCCUAAUUUGGGGCGUUUXUCX |
| 27 | 613 | VEGF | CXACUCCGCGCGGAGUCCCUUCAUUGGGGCGUUUXUCX |
| 28 | 614 | VEGF | CXACUCCGCGCGGAGGGUUAAUGGCUACCCGUUUXUCX |
| 29 | 615 | VEGF | CXACUCCGCGCGGAGUCCCUGUAAUGGGGCGUUUXUCX |
| 30 | 616 | VEGF | CXACUCCGCGCGGAGGGUUUGGCUACCCGUUUXUCX |
| 31 | 617 | VEGF | CXACUCCGCGCGGAGGCUUGAGGUAGCCGUUUXUCX |
| 32 | 618 | VEGF | CXACUCCGCGCGGAGUCCCACAUGGGGCGUUUXUCX |
| 33 | 619 | VEGF | CXACUCCGCGCGGAGGGAUGAGGUUCCCGUUUXUCX |
| 34 | 620 | VEGF | CXACUCCGCGCGGAGGCAUGAGGUUGCCGUUUXUCX |
| 35 | 621 | VEGF | CXACUCCGCGCGGAGUGCUGAGGUGCACGUUUXUCX |
| 36 | 622 | VEGF | CXACZCCGCGCGGAGGGUUGGAGGUUACCCGUUUXUCX |
| 37 | 623 | VEGF | CXACZCCGCGCGGAGUCCCUAAUUUGGGGCGUUUXUCX |
| 38 | 624 | VEGF | CXACZCCGCGCGGAGUCCCUUCAUUGGGGCGUUUXUCX |
| 39 | 625 | VEGF | CXACZCCGCGCGGAGGGUUAAUGGCUACCCGUUUXUCX |
| 40 | 626 | VEGF | CXACZCCGCGCGGAGUCCCUGUAAUGGGGCGUUUXUCX |
| 41 | 627 | VEGF | CXACZCCGCGCGGAGGGUUUGGCUACCCGUUUXUCX |
| 42 | 628 | VEGF | CXACZCCGCGCGGAGGCUUGAGGUAGCCGUUUXUCX |
| 43 | 629 | VEGF | CXACZCCGCGCGGAGUCCCACAUGGGGCGUUUXUCX |

TABLE 1-continued

| SEQ ID NO: | Aptamer | Target | Sequence |
|---|---|---|---|
| 44 | 630 | VEGF | CXACZCCGCGCGGAGGGAUGAGGUUCCCGUUUXUCX |
| 45 | 631 | VEGF | CXACZCCGCGCGGAGGCAUGAGGUUGCCGUUUXUCX |
| 46 | 632 | VEGF | CXACZCCGCGCGGAGUGCUGAGGUGCACGUUUXUCX |
| 47 | 248 | IL8 | XCXXUGGGAAAUGUGAGAUGGGUUXCCXC |
| 48 | 269 | IL8 | XXCXACXXUAXAUUAUGGGCAGUGUGACCXCXCC |
| 49 | 188 | Ang2 | XGGCAAAGGCAAAUCAAAACCGUUACAACCC |
| 50 | 204 | Ang2 | ACGGGGCAAUCCUGCCGUUUUACAGGUAAAXCCG |
| 51 | ARC1905 | C5 | CXCCGCXXUCUCAXXCGCUXAXUCUXAXUUUACCUXCX |
| 52 | ARC127 | PDGF | caggcUaCX(S18)cgtaXaXcaUCA(S18)tgatCCUX |
| 53 | 3(19) | FGF2 | XXXAUACUAXX(rG)CAUUAAUXUUACCA(rG)U(rG)UAXUCCC |
| 54 | 74 | FactorD | CCXCCUUGCCAGUAUUGGCUUAGGCUGGAAGUUUXXCXX |

Where G is 2'F RNA, X is 2'OMe G RNA, A, C, and U are 2'OMe RNA, C and U are 2'F RNA, a, g, c and t are DNA, Z is a 1,3-propanediolspacer and (S18) hexaethyleneglycol The aptamers in Table 1, can be linked to one another using a variety of different linkers, including linkers composed of 0, 1, 3 5, 10, 15 or 20 nucleotides. The identity of the nucleotides can be varied and include A, G, C, U and T. The identity of the sugar on the nucleotide can also be varied and can be comprised of 2'H deoxyribose, 2'F deoxyribose or 2'OMe ribose or 2'-O-Methoxyethyl ribose. The linker sequence can also be comprised of bridged sugars such as LNA (locked nucleic acid) or cEt (constrained ethyl) nucleotide analogs. Additionally, the linker can be composed of non-nucleotide moieties including 1,3-propanediol, 1,6 hexanediol, 1,12 dodecyldiol, triethylene glycol or hexaethylene glycol (Table 2). These molecules can be added between the two aptamers 0-5 times to vary the distance between the molecules. Additionally, the order of the aptamer domains can be varied; aptamers can be placed 5' or 3 primer the linker.

TABLE 2

| Non-nucleotide linkers |
|---|
| 1,3-propanediol |
| 1,6 hexandiol |

TABLE 2-continued

| Non-nucleotide linkers |
|---|
| 1,12 dodecyldiol |
| triethylene glycol |
| hexaethylene glycol |

Non-limiting examples of bispecific aptamer compositions are shown in Tables 3-26 that comprise a VEGF-A binding domain and an IL-8 binding domain in various configurations.

Shown in Table 3, the anti-VEGF aptamer, aptamer 285 with an inverted T (SEQ ID NO: 55), and the anti-IL8 aptamer, aptamer 269 with an inverted T (SEQ ID NO: 56) were linked with no intervening linker (SEQ ID NO: 57), a non-nucleotide linker comprised of a 3-carbon non-nucleotidyl 1,3-propanediol spacer (Z) (SEQ ID NOS: 58 and 391), a non-nucleotide linker comprised of a hexaethylene glycol spacer (S18) (SEQ ID NOS: 59 and 392), a nucleotide linker comprised of five 2'OMe deoxyuridine residues (5U) (SEQ ID NO: 60), or a nucleotide linker comprised of ten 2'OMe deoxyuridine residues (10U)(SEQ ID NO: 61). The order of the aptamer domains is also varied (SEQ ID NOS: 62 and 393; SEQ ID NOS: 63 and 394; SEQ ID NOS: 64 and 395; SEQ ID NOS: 65 and 396; and SEQ ID NOS: 66 and 397).

TABLE 3

| SEQ ID NO | 5'Apt | 3'Apt | Linker | Sequence |
|---|---|---|---|---|
| 55 | 285 | n/a | n/a | CXAC-Z-CCGCGCGGAGGGXUUUCAUAAUCCCGUUUXUCX-invdT |
| 56 | 269 | n/a | n/a | XXCXACXXUAXAUUAUGGGCAGUGUGACCXCXCC-invdT |
| 57 | 285 | 269 | none | CXAC-Z-CCGCGCGGAGGGXUUUCAUAAUCCCGUUUXUCX-XXCXACXXUAXAUUAUGGGCAGUGUGACCXCXCC-invdT |
| 58 391 | 285 | 269 | Z | CXAC-Z-CCGCGCGGAGGGXUUUCAUAAUCCCGUUUXUCX-Z-XXCXACXXUAXAUUAUGGGCAGUGUGACCXCXCC-invdT |

TABLE 3-continued

| SEQ ID NO | 5'Apt | 3'Apt | Linker | Sequence |
|---|---|---|---|---|
| 59<br>392 | 285 | 269 | S18 | CXAC-Z-CCGCGCGGAGGGXUUUCAUAAUCCCGUUUXUCX-S18-XXCXACXXUAXAUUAUGGGCAGUGUGACCXCXCC-invdT |
| 60 | 285 | 269 | 5U | CXAC-Z-CCGCGCGGAGGGXUUUCAUAAUCCCGUUUXUCX-UUUUU-XXCXACXXUAXAUUAUGGGCAGUGUGACCXCXCC-invdT |
| 61 | 285 | 269 | 10U | CXAC-Z-CCGCGCGGAGGGXUUUCAUAAUCCCGUUUXUCX-UUUUUUUUUU-XXCXACXXUAXAUUAUGGGCAGUGUGACCXCXCC-invdT |
| 62<br>393 | 269 | 285 | none | XXCXACXXUAXAUUAUGGGCAGUGUGACCXCXCC-CXAC-Z-CCGCGCGGAGGGXUUUCAUAAUCCCGUUUXUCX-invdT |
| 63<br>394 | 269 | 285 | Z | XXCXACXXUAXAUUAUGGGCAGUGUGACCXCXCC-Z-CXAC-Z-CCGCGCGGAGGGXUUUCAUAAUCCCGUUUXUCX-invdT |
| 64<br>395 | 269 | 285 | S18 | XXCXACXXUAXAUUAUGGGCAGUGUGACCXCXCC-S18-CXAC-Z-CCGCGCGGAGGGXUUUCAUAAUCCCGUUUXUCX-invdT |
| 65<br>396 | 269 | 285 | 5U | XXCXACXXUAXAUUAUGGGCAGUGUGACCXCXCC-UUUUU-CXAC-Z-CCGCGCGGAGGGXUUUCAUAAUCCCGUUUXUCX-invdT |
| 66<br>397 | 269 | 285 | 10U | XXCXACXXUAXAUUAUGGGCAGUGUGACCXCXCC-UUUUUUUUUU-CXAC-Z-CCGCGCGGAGGGXUUUCAUAAUCCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue. Sequences in bold indicate base pairs added to stabilize a terminal stem and a dash (-) is used to flank the linker.

Figure 1A:
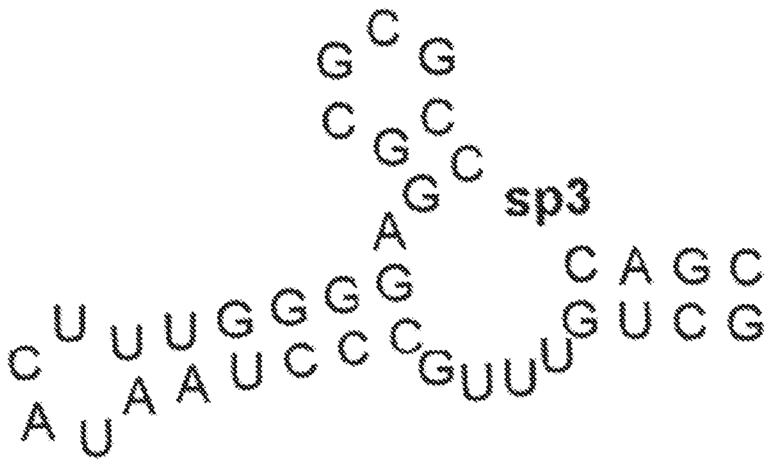
FIG. 1A Depicts structure of aptamer 285 (SEQ ID NO: 1) as folded in mfold which is consistent with the experimentally derived structure.
Figure 1B:
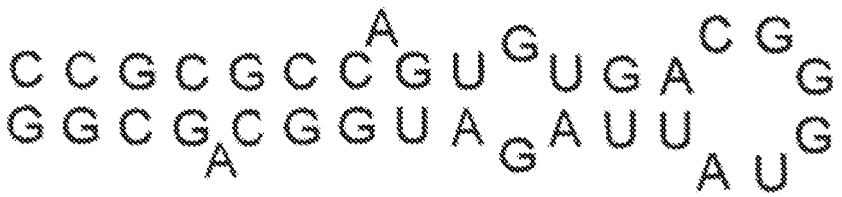
FIG. 1B Depicts structure of aptamer 269 (SEQ ID NO: 48) as folded in mfold which is consistent with the experimentally derived structure.
Figure 1C:
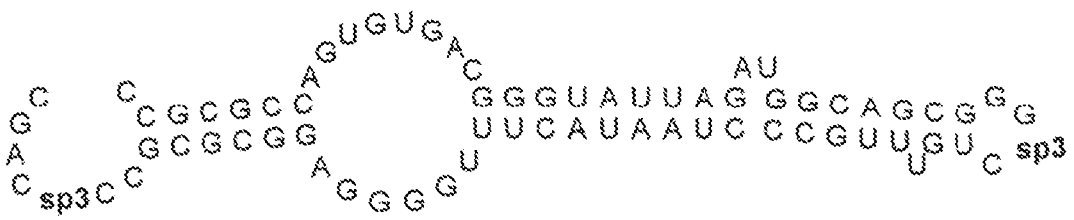
FIG. 1C Depicts structure of a bispecific aptamer comprised of aptamer 285 (SEQ ID NO: 1) and aptamer 269 (SEQ ID NO: 48) as folded in mfold. The structures of the aptamer domains are not consistent with the experimentally derived structure.
Figure 1D:
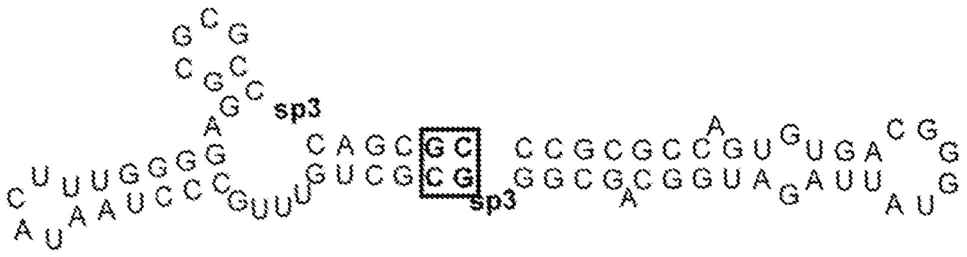
FIG. 1D Depicts structure of a bispecific aptamer comprised of a variant of aptamer 285 which has been extended by 2 base pairs (aptamer 285ex; SEQ ID NO: 67) and aptamer 269 (SEQ ID NO: 48) as folded in mfold. The structures of the aptamer domains are consistent with the experimentally derived structure. The boxed region highlights the additional base pairs.
Figure 1E:
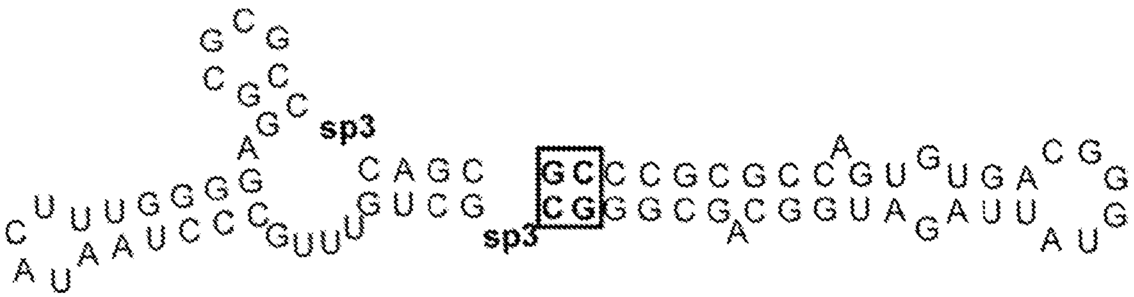
FIG. 1E Depicts the structure of a bispecific aptamer comprised of aptamer 285 (SEQ ID NO: 1) and a variant of aptamer 269 which has been extended by 2 base pairs (aptamer 269ex; SEQ ID NO: 78) as folded in mfold. The structures of the aptamer domains are consistent with the experimentally derived structure. The boxed region highlights the additional base pairs.

Using computational analysis (mfold) we observed that although in isolation each aptamer domain folds into a predicted structure consistent with experimentally derived aptamer structures (FIGS. 1A and 1B), linking the aptamers together in this manner resulted in the formation of non-native structures (FIG. 1C). Increasing distance between the domains using either a non-nucleotide linker (simulated by forcing the inter-aptamer region to be single stranded) or a nucleotide linker failed to allow the aptamers to adopt their native conformations. However, the addition of two additional base pairs to the terminal stem of aptamer 285 (SEQ ID NO: 67), or the terminal stem of aptamer 269 (SEQ ID NO: 78) within the bispecific constructs is sufficient to stabilize the native conformation of both aptamers in the context of the bispecific as predicted by mfold (FIGS. 1D and 1E).

Shown in Table 4, the extended version of 285, 285ex with an inverted T (SEQ ID NO: 67) can be combined with aptamer 269 with an inverted T (SEQ ID NO: 56) using no intervening linker (SEQ ID NO: 68), a non-nucleotide linker comprised of a 3-carbon non-nucleotidyl 1,3-propanediol spacer (Z) (SEQ ID NOS: 69 and 398), a non-nucleotide linker comprised of a hexaethylene glycol spacer (S18) (SEQ ID NOS: 70 and 399), a nucleotide linker comprised of five 2'OMe deoxyuridine residues (5U) (SEQ ID NO: 71), or a nucleotide linker comprised of ten 2'OMe deoxyuridine residues (10U) (SEQ ID NO: 72). The order of the aptamer domains is also varied (SEQ ID NOS: 73 and 400; SEQ ID NOS: 74 and 401; SEQ ID NOS:75 and 402; SEQ ID NOS: 76 and 403; and SEQ ID NOS: 77 and 404).

TABLE 4

| SEQ ID NO | 5'Apt | 3'Apt | Linker | Sequence |
|---|---|---|---|---|
| 67 | 285ex | n/a | n/a | **XC**CXAC-Z-CCGCGCGGAGGGXUUUCAUAAUCCCGUUUXUCX**XC**-invdT |
| 56 | 269 | n/a | n/a | XXCXACXXUAXAUUAUGGGCAGUGUGACCXCXCC-invdT |
| 68 | 285ex | 269 | none | **XC**CXAC-Z-CCGCGCGGAGGGXUUUCAUAAUCCCGUUUXUCX**XC**-XXCXACXXUAXAUUAUGGGCAGUGUGACCXCXCC-invdT |
| 69<br>398 | 285ex | 269 | Z | **XC**CXAC-Z-CCGCGCGGAGGGXUUUCAUAAUCCCGUUUXUCX**XC**-Z-XXCXACXXUAXAUUAUGGGCAGUGUGACCXCXCC-invdT |
| 70<br>399 | 285ex | 269 | S18 | **XC**CXAC-Z-CCGCGCGGAGGGXUUUCAUAAUCCCGUUUXUCX**XC**-S18-XXCXACXXUAXAUUAUGGGCAGUGUGACCXCXCC-invdT |

TABLE 4-continued

| SEQ ID NO | 5'Apt | 3'Apt | Linker | Sequence |
|---|---|---|---|---|
| 71 | 285ex | 269 | 5U | **XC**CXAC-Z-CCGCGCGGAGGGXUUUCAUAAUCCCGUUUXUCX**XC**-UUUUU-XXCXACXXUAXAUUAUGGGCAGUGUGACCXCXCC-invdT |
| 72 | 285ex | 269 | 10U | **XC**CXAC-Z-CCGCGCGGAGGGXUUUCAUAAUCCCGUUUXUCX**XC**-UUUUUUUUUU-XXCXACXXUAXAUUAUGGGCAGUGUGACCXCXCC-invdT |
| 73 400 | 269 | 285ex | none | XXCXACXXUAXAUUAUGGGCAGUGUGACCXCX**XC**C-XCCXAC-Z-CCGCGCGGAGGGXUUUCAUAAUCCCGUUUXUCX**XC**-invdT |
| 74 401 | 269 | 285ex | Z | XXCXACXXUAXAUUAUGGGCAGUGUGACCXCXCC-Z-**XC**CXAC-Z-CCGCGCGGAGGGXUUUCAUAAUCCCGUUUXUCX**XC**-invdT |
| 75 402 | 269 | 285ex | S18 | XXCXACXXUAXAUUAUGGGCAGUGUGACCXCXCC-S18-**XC**CXAC-Z-CCGCGCGGAGGGXUUUCAUAAUCCCGUUUXUCX**XC**-invdT |
| 76 403 | 269 | 285ex | 5U | XXCXACXXUAXAUUAUGGGCAGUGUGACCXCXCC-UUUUU-**XC**CXAC-Z-CCGCGCGGAGGGXUUUCAUAAUCCCGUUUXUCX**XC**-invdT |
| 77 404 | 269 | 285ex | 10U | XXCXACXXUAXAUUAUGGGCAGUGUGACCXCXCC-UUUUUUUUUU-**XC**CXAC-Z-CCGCGCGGAGGGXUUUCAUAAUCCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue. Sequences in bold indicate base pairs added to stabilize a terminal stem and a dash (-) is used to flank the linker.

Shown in Table 5, the extended version of 269, 269ex with an inverted T (SEQ ID NO: 78) can be combined with aptamer 285 with an inverted T (SEQ ID NO: 55) using no intervening linker (SEQ ID NO: 79), a non-nucleotide linker comprised of a 3-carbon non-nucleotidyl 1,3-propanediol spacer (Z) (SEQ ID NOS: 80 and 405), a non-nucleotide linker comprised of a hexaethylene glycol spacer (S18) (SEQ ID NOS: 81 and 406), a nucleotide linker comprised of five 2'OMe deoxyuridine residues (5U) (SEQ ID NO: 82), or a nucleotide linker comprised often 2'OMe deoxyuridine residues (10U) (SEQ ID NO: 83). The order of the aptamer domains is also varied (SEQ ID NOS: 84 and 407; SEQ ID NOS: 85 and 408; SEQ ID NOS: 86 and 409; SEQ ID NOS: 87 and 410; and SEQ ID NOS: 88 and 411).

TABLE 5

| SEQ ID NO | 5'Apt | 3'Apt | Linker | Sequence |
|---|---|---|---|---|
| 55 | 285 | n/a | n/a | CXAC-Z-CCGCGCGGAGGGXUUUCAUAAUCCCGUUUXUCX-invdT |
| 78 | 269ex | n/a | n/a | **XC**XXCXACXXUAXAUUAUGGGCAGUGUGACCXCXCC**XC**-invdT |
| 79 | 285 | 269ex | none | CXAC-Z-CCGCGCGGAGGGXUUUCAUAAUCCCGUUUXUCX-**XC**XXCXACXXUAXAUUAUGGGCAGUGUGACCXCXCC**XC**-invdT |
| 80 405 | 285 | 269ex | Z | CXAC-Z-CCGCGCGGAGGGXUUUCAUAAUCCCGUUUXUCX-Z-**XC**XXCXACXXUAXAUUAUGGGCAGUGUGACCXCXCC**XC**-invdT |
| 81 406 | 285 | 269ex | S18 | CXAC-Z-CCGCGCGGAGGGXUUUCAUAAUCCCGUUUXUCX-S18-**XC**XXCXACXXUAXAUUAUGGGCAGUGUGACCXCXCC**XC**-invdT |
| 82 | 285 | 269ex | 5U | CXAC-Z-CCGCGCGGAGGGXUUUCAUAAUCCCGUUUXUCX-UUUUU-**XC**XXCXACXXUAXAUUAUGGGCAGUGUGACCXCXCC**XC**-invdT |
| 83 | 285 | 269ex | 10U | CXAC-Z-CCGCGCGGAGGGXUUUCAUAAUCCCGUUUXUCX-UUUUUUUUUU-**XC**XXCXACXXUAXAUUAUGGGCAGUGUGACCXCXCC**XC**-invdT |

TABLE 5-continued

| SEQ ID NO | 5'Apt | 3'Apt | Linker | Sequence |
|---|---|---|---|---|
| 84<br>407 | 269ex | 285 | none | **XC**XXCXACXXUAXAUUAUGGGCAGUGUGACCXCXCC**XC**-CXAC-Z-CCGCGCGGAGGGXUUUCAUAAUCCCGUUUXUCX-invdT |
| 85<br>408 | 269ex | 285 | Z | **XC**XXCXACXXUAXAUUAUGGGCAGUGUGACCXCXCC**XC**-Z-CXAC-Z-CCGCGCGGAGGGXUUUCAUAAUCCCGUUUXUCX-invdT |
| 86<br>409 | 269ex | 285 | S18 | **XC**XXCXACXXUAXAUUAUGGGCAGUGUGACCXCXCC**XC**-S18-CXAC-Z-CCGCGCGGAGGGXUUUCAUAAUCCCGUUUXUCX-invdT |
| 87<br>410 | 269ex | 285 | 5U | **XC**XXCXACXXUAXAUUAUGGGCAGUGUGACCXCXCC**XC**-UUUUU-CXAC-Z-CCGCGCGGAGGGXUUUCAUAAUCCCGUUUXUCX-invdT |
| 88<br>411 | 269ex | 285 | 10U | **XC**XXCXACXXUAXAUUAUGGGCAGUGUGACCXCXCC**XC**-UUUUUUUUUU-CXAC-Z-CCGCGCGGAGGGXUUUCAUAAUCCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue. Sequences in bold indicate base pairs added to stabilize a terminal stem and a dash (-) is used to flank the linker.

Shown in Table 6, the extended version of 285 with an inverted T (SEQ ID NO: 67) can be combined with the extended version of aptamer 269 with an inverted T (SEQ ID NO: 78) using no intervening linker (SEQ ID NO: 89), a non-nucleotide linker comprised of a 3-carbon non-nucleotidyl 1,3-propanediol spacer (Z) (SEQ ID NOS: 90 and 412), a non-nucleotide linker comprised of a hexaethylene glycol spacer (S18) (SEQ ID NOS: 91 and 413), a nucleotide linker comprised of five 2'OMe deoxyuridine residues (5U) (SEQ ID NO: 92), or a nucleotide linker comprised of ten 2'OMe deoxyuridine residues (10U) (SEQ ID NO: 93). The order of the aptamer is also varied (SEQ ID NOS: 94 and 414; SEQ ID NOS: 95 and 415; SEQ ID NOS: 96 and 416; SEQ ID NOS: 97 and 417; and SEQ ID NOS: 98-418).

TABLE 6

| SEQ ID NO | 5'Apt | 3'Apt | Linker | Sequence |
|---|---|---|---|---|
| 67 | 285ex | n/a | n/a | **XC**CXAC-Z-CCGCGCGGAGGGXUUUCAUAAUCCCGUUUXUCX**XC**-invdT |
| 78 | 269ex | n/a | n/a | **XC**XXCXACXXUAXAUUAUGGGCAGUGUGACCXCXCC**XC**-invdT |
| 89 | 285ex | 269ex | none | **XC**CXAC-Z-CCGCGCGGAGGGXUUUCAUAAUCCCGUUUXUCX**XC**-**XC**XXCXACXXUAXAUUAUGGGCAGUGUGACCXCXCC**XC**-invdT |
| 90<br>412 | 285ex | 269ex | Z | **XC**CXAC-Z-CCGCGCGGAGGGXUUUCAUAAUCCCGUUUXUCX**XC**-Z-**XC**XXCXACXXUAXAUUAUGGGCAGUGUGACCXCXCC**XC**-invdT |
| 91<br>413 | 285ex | 269ex | S18 | **XC**CXAC-Z-CCGCGCGGAGGGXUUUCAUAAUCCCGUUUXUCX**XC**-S18-**XC**XXCXACXXUAXAUUAUGGGCAGUGUGACCXCXCC**XC**-invdT |
| 92 | 285ex | 269ex | 5U | **XC**CXAC-Z-CCGCGCGGAGGGXUUUCAUAAUCCCGUUUXUCX**XC**-UUUUU-**XC**XXCXACXXUAXAUUAUGGGCAGUGUGACCXCXCC**XC**-invdT |
| 93 | 285ex | 269ex | 10U | **XC**CXAC-Z-CCGCGCGGAGGGXUUUCAUAAUCCCGUUUXUCX**XC**-UUUUUUUUUU-**XC**XXCXACXXUAXAUUAUGGGCAGUGUGACCXCXCC**XC**-invdT |
| 94<br>414 | 269ex | 285ex | none | **XC**XXCXACXXUAXAUUAUGGGCAGUGUGACCXCXCC**XC**-**XC**CXAC-Z-CCGCGCGGAGGGXUUUCAUAAUCCCGUUUXUCX**XC**-invdT |

TABLE 6-continued

| SEQ ID NO | 5'Apt | 3'Apt | Linker | Sequence |
|---|---|---|---|---|
| 95 415 | 269ex | 285ex | Z | **XC**XXCXACXXUAXAUUAUGGGCAGUGUGACCXCXCC**XC**-Z-**XC**CXAC-Z-CCGCGCGGAGGGXUUUCAUAAUCCCGUUUXUCX**XC**-invdT |
| 96 416 | 269ex | 285ex | S18 | **XC**XXCXACXXUAXAUUAUGGGCAGUGUGACCXCXCC**XC**-S18-**XC**CXAC-Z-CCGCGCGGAGGGXUUUCAUAAUCCCGUUUXUCX**XC**-invdT |
| 97 417 | 269ex | 285ex | 5U | **XC**XXCXACXXUAXAUUAUGGGCAGUGUGACCXCXCC**XC**-UUUUU-**XC**CXAC-Z-CCGCGCGGAGGGXUUUCAUAAUCCCGUUUXUCX**XC**-invdT |
| 98 418 | 269ex | 285ex | 10U | **XC**XXCXACXXUAXAUUAUGGGCAGUGUGACCXCXCC**XC**-UUUUUUUUUU-**XC**CXAC-Z-CCGCGCGGAGGGXUUUCAUAAUCCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue. Sequences in bold indicate base pairs added to stabilize a terminal stem and a dash (-) is used to flank the linker.

Bispecific aptamer designs were extended to include other variants of aptamer 285 which were identified during a selection in which the Loop 4 of the aptamer was randomized. Shown in Table 7 are examples of bispecific aptamers sequences using anti-VEGF aptamer, aptamer 481 with an inverted T (SEQ ID NO: 99), and the anti-IL8 aptamer, aptamer 269 with an inverted T (SEQ ID NO: 56) linked with no intervening linker (SEQ ID NO: 100), a non-nucleotide linker comprised of a 3-carbon non-nucleotidyl 1,3-propanediol spacer (Z) (SEQ ID NOS: 101 and 419), a non-nucleotide linker comprised of a hexaethylene glycol spacer (S18) (SEQ ID NOS: 102 and 420), a nucleotide linker comprised of five 2'OMe deoxyuridine residues (5U) (SEQ ID NO: 103), or a nucleotide linker comprised often 2'OMe deoxyuridine residues (OU) (SEQ ID NO: 104). The order of the aptamer domains is also varied (SEQ ID NO: 105; SEQ ID NOS: 106, 421, and 422; and SEQ ID NOs: 107-109).

TABLE 7

| SEQ ID NO | 5'Apt | 3'Apt | Linker | Sequence |
|---|---|---|---|---|
| 99 | 481 | n/a | n/a | CXACUCCGCGCGGAGGCUUGAGGUAGCCGUUUXUCX-invdT |
| 56 | 269 | n/a | n/a | XXCXACXXUAXAUUAUGGGCAGUGUGACCXCXCC-invdT |
| 100 | 481 | 269 | none | CXACUCCGCGCGGAGGCUUGAGGUAGCCGUUUXUCX-XXCXACXXUAXAUUAUGGGCAGUGUGACCXCXCC-invdT |
| 101 419 | 481 | 269 | Z | CXACUCCGCGCGGAGGCUUGAGGUAGCCGUUUXUCX-Z-XXCXACXXUAXAUUAUGGGCAGUGUGACCXCXCC-invdT |
| 102 420 | 481 | 269 | S18 | CXACUCCGCGCGGAGGCUUGAGGUAGCCGUUUXUCX-S18-XXCXACXXUAXAUUAUGGGCAGUGUGACCXCXCC-invdT |
| 103 | 481 | 269 | 5U | CXACUCCGCGCGGAGGCUUGAGGUAGCCGUUUXUCX-UUUUU-XXCXACXXUAXAUUAUGGGCAGUGUGACCXCXCC-invdT |
| 104 | 285 | 269 | 10U | CXACUCCGCGCGGAGGCUUGAGGUAGCCGUUUXUCX-UUUUUUUUUU-XXCXACXXUAXAUUAUGGGCAGUGUGACCXCXCC-invdT |

TABLE 7-continued

| SEQ ID NO | 5'Apt | 3'Apt | Linker | Sequence |
|---|---|---|---|---|
| 105 | 269 | 481 | none | XXCXACXXUAXAUUAUGGGCAGUGUGACCXCXCC-CXACUCCGCGCGGAGGCUUGAGGUAGCCGUUUXUCX-invdT |
| 106 421 422 | 269 | 481 | Z | XXCXACXXUAXAUUAUGGGCAGUGUGACCXCXCC-Z-CXACUCCGCGCGGAGGCUUGAGGUAGCCGUUUXUCX-invdT XXCXACXXUAXAUUAUGGGCAGUGUGACCXCXCC-S18-CXACUCCGCGCGGAGGCUUGAGGUAGCCGUUUXUCX-invdT |
| 107 | 269 | 481 | S18 | XXCXACXXUAXAUUAUGGGCAGUGUGACCXCXCC-UUUUU-CXACUCCGCGCGGAGGCUUGAGGUAGCCGUUUXUCX-invdT |
| 108 | 269 | 481 | 5U | XXCXACXXUAXAUUAUGGGCAGUGUGACCXCXCC-UUUUUUUUUU-CXACUCCGCGCGGAGGCUUGAGGUAGCCGUUUXUCX-invdT |
| 109 | 269 | 481 | 10U | XXCXACXXUAXAUUAUGGGCAGUGUGACCXCXCC-CXACUCCGCGCGGAGGCUUGAGGUAGCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 8, an extended version of aptamer 481, 481ex with an inverted T (SEQ ID NO: 110) that contains two additional base pairs to stabilize the closing stem is combined with aptamer 269 with an inverted T (SEQ ID NO: 56) using no intervening linker (SEQ ID NO: 111), a non-nucleotide linker comprised of a 3-carbon non-nucleotidyl 1,3-propanediol spacer (Z) (SEQ ID NOS: 112 and 423), a non-nucleotide linker comprised of a hexaethylene glycol spacer (S18) (SEQ ID NO: 113 and 424), a nucleotide linker comprised of five 2'OMe deoxyuridine residues (5U) (SEQ ID NO: 114), or a nucleotide linker comprised of ten 2'OMe deoxyuridine residues (10U) (SEQ ID NO: 115). The order of the aptamer domains is also varied (SEQ ID NO: 116; SEQ ID NOS: 117 and 425; SEQ ID NOS: 118 and 426 and SEQ ID NOS:119-120).

TABLE 8

| SEQ ID NO | 5'Apt | 3'Apt | Linker | Sequence |
|---|---|---|---|---|
| 110 | 481ex | n/a | n/a | **XC**CXACUCCGCGCGGAGGCUUGAGGUAGCCGUUUXUCX**XC**-invdT |
| 56 | 269 | n/a | n/a | XXCXACXXUAXAUUAUGGGCAGUGUGACCXCXCC-invdT |
| 111 | 481ex | 269 | none | **XC**CXACUCCGCGCGGAGGCUUGAGGUAGCCGUUUXUCX**XC**-XXCXACXXUAXAUUAUGGGCAGUGUGACCXCXCC-invdT |
| 112 423 | 481ex | 269 | Z | **XC**CXACUCCGCGCGGAGGCUUGAGGUAGCCGUUUXUCX**XC**-Z-XXCXACXXUAXAUUAUGGGCAGUGUGACCXCXCC-invdT |
| 113 424 | 481ex | 269 | S18 | **XC**CXACUCCGCGCGGAGGCUUGAGGUAGCCGUUUXUCX**XC**-S18-XXCXACXXUAXAUUAUGGGCAGUGUGACCXCXCC-invdT |
| 114 | 481ex | 269 | 5U | **XC**CXACUCCGCGCGGAGGCUUGAGGUAGCCGUUUXUCX**XC**-UUUUU-XXCXACXXUAXAUUAUGGGCAGUGUGACCXCXCC-invdT |
| 115 | 481ex | 269 | 10U | **XC**CXACUCCGCGCGGAGGCUUGAGGUAGCCGUUUXUCX**XC**-UUUUUUUUUU-XXCXACXXUAXAUUAUGGGCAGUGUGACCXCXCC-invdT |
| 116 | 269 | 481ex | none | XXCXACXXUAXAUUAUGGGCAGUGUGACCXCXCC-**XC**CXACUCCGCGCGGAGGCUUGAGGUAGCCGUUUXUCX**XC**-invdT |
| 117 425 | 269 | 481ex | Z | XXCXACXXUAXAUUAUGGGCAGUGUGACCXCXCC-Z-**XC**CXACUCCGCGCGGAGGCUUGAGGUAGCCGUUUXUCX**XC**-invdT |
| 118 426 | 269 | 481ex | S18 | XXCXACXXUAXAUUAUGGGCAGUGUGACCXCXCC-S18-**XC**CXACUCCGCGCGGAGGCUUGAGGUAGCCGUUUXUCX**XC**-invdT |
| 119 | 269 | 481ex | 5U | XXCXACXXUAXAUUAUGGGCAGUGUGACCXCXCC-UUUUU-**XC**CXACUCCGCGCGGAGGCUUGAGGUAGCCGUUUXUCX**XC**-invdT |
| 120 | 269 | 481ex | 10U | XXCXACXXUAXAUUAUGGGCAGUGUGACCXCXCC-UUUUUUUUUU-**XC**CXACUCCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

TABLE 9

| SEQ ID NO | 5'Apt | 3'Apt | Linker | Sequence |
|---|---|---|---|---|
| 99 | 481 | n/a | n/a | CXACUCCGCGCGGAGGCUUGAGGUAGCCGUUUXUCX-invdT |
| 78 | 269ex | n/a | n/a | **XC**XXCXACXXUAXAUUAUGGGCAGUGUGACCXCXCC**XC**-invdT |
| 121 | 481 | 269ex | none | CXACUCCGCGCGGAGGCUUGAGGUAGCCGUUUXUCX-**XC**XXCXACXXUAXAUUAUGGGCAGUGUGACCXCXCC**XC**-invdT |
| 122 427 | 481 | 269ex | Z | CXACUCCGCGCGGAGGCUUGAGGUAGCCGUUUXUCX-Z-**XC**XXCXACXXUAXAUUAUGGGCAGUGUGACCXCXCC**XC**-invdT |
| 123 428 | 481 | 269ex | S18 | CXACUCCGCGCGGAGGCUUGAGGUAGCCGUUUXUCX-S18-**XC**XXCXACXXUAXAUUAUGGGCAGUGUGACCXCXCC**XC**-invdT |
| 124 | 481 | 269ex | 5U | CXACUCCGCGCGGAGGCUUGAGGUAGCCGUUUXUCX-UUUUU-**XC**XXCXACXXUAXAUUAUGGGCAGUGUGACCXCXCC**XC**-invdT |
| 125 | 285 | 269ex | 10U | CXACUCCGCGCGGAGGCUUGAGGUAGCCGUUUXUCX-UUUUUUUUUU-**XC**XXCXACXXUAXAUUAUGGGCAGUGUGACCXCXCC**XC**-invdT |
| 126 | 269ex | 481 | none | XXCXACXXUAXAUUAUGGGCAGUGUGACCXCXCC-**XC**CXACUCCGCGCGGAGGCUUGAGGUAGCCGUUUXUCX**XC**-invdT |
| 127 429 | 269ex | 481 | Z | XXCXACXXUAXAUUAUGGGCAGUGUGACCXCXCC-Z-**XC**CXACUCCGCGCGGAGGCUUGAGGUAGCCGUUUXUCX**XC**-invdT |
| 128 430 | 269ex | 481 | S18 | XXCXACXXUAXAUUAUGGGCAGUGUGACCXCXCC-S18-**XC**CXACUCCGCGCGGAGGCUUGAGGUAGCCGUUUXUCX**XC**-invdT |
| 129 | 269ex | 481 | 5U | XXCXACXXUAXAUUAUGGGCAGUGUGACCXCXCC-UUUUU-**XC**CXACUCCGCGCGGAGGCUUGAGGUAGCCGUUUXUC**XXC**-invdT |
| 130 | 269ex | 481 | 10U | XXCXACXXUAXAUUAUGGGCAGUGUGACCXCXCC-UUUUUUUUUU-**XC**CXACUCCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 9, the extended version of 269, 269ex with an inverted T (SEQ ID NO: 78) is combined with aptamer 481 with an inverted T (SEQ ID NO: 99) using no intervening linker (SEQ ID NO: 121), a non-nucleotide linker comprised of a 3-carbon non-nucleotidyl 1,3-propanediol spacer (Z) (SEQ ID NOS: 122 and 427), a non-nucleotide linker comprised of a hexaethylene glycol spacer (S18) (SEQ ID NOS: 123 and 428), a nucleotide linker comprised of five 2'OMe deoxyuridine residues (5U) (SEQ ID NO: 124), or a nucleotide linker comprised of ten 2'OMe deoxyuridine residues (10U) (SEQ ID NO: 125). The order of the aptamer domains is also varied.

Shown in Table 10, the extended version of 481 (SEQ ID NO: 99) is combined with the extended version of aptamer 269 (SEQ ID NO: 78) using no intervening linker (SEQ ID NO: 131), a non-nucleotide linker comprised of a 3-carbon non-nucleotidyl 1,3-propanediol spacer (Z) (SEQ ID NOS: 132 and 431), a non-nucleotide linker comprised of a hexaethylene glycol spacer (S18) (SEQ ID NOS: 133 and 432), a nucleotide linker comprised of five 2'OMe deoxyuridine residues (5U) (SEQ ID NO: 134), or a nucleotide linker comprised of ten 2'OMe deoxyuridine residues (10U) (SEQ ID NO: 135). The order of the aptamer domains is also varied (SEQ ID NOS: 136-140).

TABLE 10

| SEQ ID NO | 5' Apt | 3'Apt | Linker | Sequence |
|---|---|---|---|---|
| 99 | 481ex | n/a | n/a | **XC**CXACUCCGCGCGGAGGCUUGAGGUAGCCGUUUXUCX**XC**-invdT |
| 78 | 269ex | n/a | n/a | **XC**XXCXACXXUAXAUUAUGGGCAGUGUGACCXCXCC**XC**-invdT |
| 131 | 481ex | 269ex | none | **XC**CXACUCCGCGCGGAGGCUUGAGGUAGCCGUUUXUCX**XC**-**XC**XXCXACXXUAXAUUAUGGGCAGUGUGACCXCXCC**XC**-invdT |
| 132 431 | 481ex | 269ex | Z | **XC**CXACUCCGCGCGGAGGCUUGAGGUAGCCGUUUXUCX**XC**-Z-**XC**XXCXACXXUAXAUUAUGGGCAGUGUGACCXCXCC**XC**-invdT |
| 133 432 | 481ex | 269ex | S18 | **XC**CXACUCCGCGCGGAGGCUUGAGGUAGCCGUUUXUCX**XC**-S18-**XC**XXCXACXXUAXAUUAUGGGCAGUGUGACCXCXCC**XC**-invdT |
| 134 | 481ex | 269ex | 5U | **XC**CXACUCCGCGCGGAGGCUUGAGGUAGCCGUUUXUCX**XC**-UUUUU-**XC**XXCXACXXUAXAUUAUGGGCAGUGUGACCXCXCC**XC**-invdT |
| 135 | 481ex | 269ex | 10U | **XC**CXACUCCGCGCGGAGGCUUGAGGUAGCCGUUUXUCX**XC**-UUUUUUUUUU-**XC**XXCXACXXUAXAUUAUGGGCAGUGUGACCXCXCC**XC**-invdT |
| 136 | 269ex | 481ex | none | **XC**XXCXACXXUAXAUUAUGGGCAGUGUGACCXCXCC**XC**-**XC**CXACUCCGCGCGGAGGCUUGAGGUAGCCGUUUXUCX**XC**-invdT |
| 137 | 269ex | 481ex | Z | **XC**XXCXACXXUAXAUUAUGGGCAGUGUGACCXCXCC**XC**-**XC**CXACUCCGCGCGGAGGCUUGAGGUAGCCGUUUXUCX**XC**-invdT |
| 138 | 269ex | 481ex | S18 | **XC**XXCXACXXUAXAUUAUGGGCAGUGUGACCXCXCC**XC**-**XC**CXACUCCGCGCGGAGGCUUGAGGUAGCCGUUUXUCX**XC**-invdT |
| 139 | 269ex | 481ex | 5U | **XC**XXCXACXXUAXAUUAUGGGCAGUGUGACCXCXCC**XC**-UUUUU-**XC**CXACUCCGCGCGGAGGCUUGAGGUAGCCGUUUXUCX**XC**-invdT |
| 140 | 269ex | 481ex | 10U | **XC**XXCXACXXUAXAUUAUGGGCAGUGUGACCXCXCC**XC**-UUUUUUUUUU-**XC**CXACUCCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Aptamer 628 (SEQ ID NO: 141) is a variant of aptamer 481 in which the U at position 5 relative to the start of aptamer 481 has been replaced with a Z non-nucleotidyl linker. Shown in Table 11 are examples of bispecific aptamers sequences generated using anti-VEGF aptamer, aptamer 628 with an inverted T (SEQ ID: 141), and the anti-IL8 aptamer, aptamer 269 with an inverted T (SEQ ID NO: 56) linked with no intervening linker (SEQ ID NO: 142), a non-nucleotide linker comprised of a 3-carbon non-nucleotidyl 1,3-propanediol spacer (Z) (SEQ ID NOS: 143 and 433), a non-nucleotide linker comprised of a hexaethylene glycol spacer (S18) (SEQ ID NOS: 144 and 434), a nucleotide linker comprised of five 2'OMe deoxyuridine residues (5U) (SEQ ID NO: 145), or a nucleotide linker comprised of ten 2'OMe deoxyuridine residues (10U) (SEQ ID NO: 146). The order of the aptamer domains is also varied (SEQ ID NOS: 147 and 435; SEQ ID NOS: 148 and 436; SEQ ID NOS: 149 and 437; SEQ ID NOS: 150 and 438; and SEQ ID NO: 151).

TABLE 11

| SEQ ID NO | 5'Apt | 3'Apt | Linker | Sequence |
|---|---|---|---|---|
| 141 | 628 | n/a | n/a | CXAC-Z-CCGCGCGGAGGCUUGAGGUAGCCGUUUXUCX-invdT |
| 56 | 269 | n/a | n/a | XXCXACXXUAXAUUAUGGGCAGUGUGACCXCXCC-invdT |
| 142 | 628 | 269 | none | CXAC-Z-CCGCGCGGAGGCUUGAGGUAGCCGUUUXUCX-XXCXACXXUAXAUUAUGGGCAGUGUGACCXCXCC-invdT |
| 143 433 | 628 | 269 | Z | CXAC-Z-CCGCGCGGAGGCUUGAGGUAGCCGUUUXUCX-Z-XXCXACXXUAXAUUAUGGGCAGUGUGACCXCXCC-invdT |
| 144 434 | 628 | 269 | S18 | CXAC-Z-CCGCGCGGAGGCUUGAGGUAGCCGUUUXUCX-S18-XXCXACXXUAXAUUAUGGGCAGUGUGACCXCXCC-invdT |
| 145 | 628 | 269 | 5U | CXAC-Z-CCGCGCGGAGGCUUGAGGUAGCCGUUUXUCX-UUUUU-XXCXACXXUAXAUUAUGGGCAGUGUGACCXCXCC-invdT |
| 146 | 628 | 269 | 10U | CXAC-Z-CCGCGCGGAGGCUUGAGGUAGCCGUUUXUCX-UUUUUUUUUU-XXCXACXXUAXAUUAUGGGCAGUGUGACCXCXCC-invdT |
| 147 435 | 269 | 628 | none | XXCXACXXUAXAUUAUGGGCAGUGUGACCXCXCC-CXAC-Z-CCGCGCGGAGGCUUGAGGUAGCCGUUUXUCX-invdT |
| 148 436 | 269 | 628 | Z | XXCXACXXUAXAUUAUGGGCAGUGUGACCXCXCC-Z-CXAC-Z-CCGCGCGGAGGCUUGAGGUAGCCGUUUXUCX-invdT |
| 149 437 | 269 | 628 | S18 | XXCXACXXUAXAUUAUGGGCAGUGUGACCXCXCC-S18-CXAC-Z-CCGCGCGGAGGCUUGAGGUAGCCGUUUXUCX-invdT |
| 150 438 | 269 | 628 | 5U | XXCXACXXUAXAUUAUGGGCAGUGUGACCXCXCC-UUUUU-CXAC-Z-CCGCGCGGAGGCUUGAGGUAGCCGUUUXUCX-invdT |

TABLE 11-continued

| SEQ ID NO | 5'Apt | 3'Apt | Linker | Sequence |
|---|---|---|---|---|
| 151 442 | 269 | 628 | 10U | XXCXACXXUAXAUUAUGGGCAGUGUGACCXCXCC-UUUUUUUUUU-CXAC-Z-CCGCGCGGAGGCUUGAGGUAGCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 12, an extended version of aptamer 628, 628ex with an inverted T (SEQ ID NO: 152) that contains two additional base pairs to stabilize the closing stem is combined with aptamer 269 with an inverted T (SEQ ID NO: 56) using no intervening linker (SEQ ID NO: 439), a non-nucleotide linker comprised of a 3-carbon non-nucleotidyl 1,3-propanediol spacer (Z) (SEQ ID NOS: 163 and 391), a non-nucleotide linker comprised of a hexaethylene glycol spacer (S18) (SEQ ID NOS: 164 and 434), a nucleotide linker comprised of five 2'OMe deoxyuridine residues (5U) (SEQ ID NO: 440), or a nucleotide linker comprised of ten 2'OMe deoxyuridine residues (10U) (SEQ ID NO: 441). The order of the aptamer domains is also varied (SEQ ID NOS: 73 and 302; SEQ ID NOS: 74 and 302; SEQ ID NOS: 76 and 302; SEQ ID NOS: 77 and 302).

TABLE 12

| SEQ ID NO | 5'Apt | 3'Apt | Linker | Sequence |
|---|---|---|---|---|
| 152 | 628ex | n/a | n/a | **XC**CXAC-Z-CCGCGCGGAGGCUUGAGGUAGCCGUUUXUCX**XC**-invdT |
| 56 | 269 | n/a | n/a | XXCXACXXUAXAUUAUGGGCAGUGUGACCXCXCC-invdT |
| 439 | 628ex | 269 | none | **XC**CXAC-Z-CCGCGCGGAGGCUUGAGGUAGCCGUUUXUCX**XC**-XXCXACXXUAXAUUAUGGGCAGUGUGACCXCXCC-invdT |
| 163 391 | 628ex | 269 | Z | **XC**CXAC-Z-CCGCGCGGAGGCUUGAGGUAGCCGUUUXUCX**XC**-Z-XXCXACXXUAXAUUAUGGGCAGUGUGACCXCXCC-invdT |
| 164 434 | 628ex | 269 | S18 | **XC**CXAC-Z-CCGCGCGGAGGCUUGAGGUAGCCGUUUXUCX**XC**-S18-XXCXACXXUAXAUUAUGGGCAGUGUGACCXCXCC-invdT |
| 440 | 628ex | 269 | 5U | **XC**CXAC-Z-CCGCGCGGAGGCUUGAGGUAGCCGUUUXUCX**XC**-UUUUU-XXCXACXXUAXAUUAUGGGCAGUGUGACCXCXCC-invdT |
| 441 | 628ex | 269 | 10U | **XC**CXAC-Z-CCGCGCGGAGGCUUGAGGUAGCCGUUUXUCX**XC**-UUUUUUUUUU-XXCXACXXUAXAUUAUGGGCAGUGUGACCXCXCC-invdT |

TABLE 12-continued

| SEQ ID NO | 5'Apt | 3'Apt | Linker | Sequence |
|---|---|---|---|---|
| 73 302 | 269 | 628ex | none | XXCXACXXUAXAUUAUGGGCAGUGUGACCXCXCC-**XC**CXAC-Z-CCGCGCGGAGGCUUGAGGUAGCCGUUUXUCX**XC**-invdT |
| 74 302 | 269 | 628ex | Z | XXCXACXXUAXAUUAUGGGCAGUGUGACCXCXCC-Z-**XC**CXAC-Z-CCGCGCGGAGGCUUGAGGUAGCCGUUUXUCX**XC**-invdT |
| 149 302 | 269 | 628ex | S18 | XXCXACXXUAXAUUAUGGGCAGUGUGACCXCXCC-S18-**XC**CXAC-Z-CCGCGCGGAGGCUUGAGGUAGCCGUUUXUCX**XC**-invdT |
| 76 302 | 269 | 628ex | 5U | XXCXACXXUAXAUUAUGGGCAGUGUGACCXCXCC-UUUUU-**XC**CXAC-Z-CCGCGCGGAGGCUUGAGGUAGCCGUUUXUCX**XC**-invdT |
| 77 302 | 269 | 628ex | 10U | XXCXACXXUAXAUUAUGGGCAGUGUGACCXCXCC-UUUUUUUUUU-**XC**CXAC-Z-CCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 13, the extended version of 269, 269ex with an inverted T (SEQ ID NO: 78) is combined with aptamer 628 with an inverted T (SEQ ID NO: 141) using no intervening linker (SEQ ID NO: 152), a non-nucleotide linker comprised of a 3-carbon non-nucleotidyl 1,3-propanediol spacer (Z) (SEQ ID NOS: 153 and 303), a non-nucleotide linker comprised of a hexaethylene glycol spacer (S18) (SEQ ID NOS: 154 and 304), a nucleotide linker comprised of five 2'OMe deoxyuridine residues (5U) (SEQ ID NO: 155), or a nucleotide linker comprised of ten 2'OMe deoxyuridine residues (10U) (SEQ ID NO: 156). The order of the aptamer domains is also varied (SEQ ID NOS: 157 and 305; SEQ ID NOS: 158 and 306; SEQ ID NOS: 159 and 307; SEQ ID NOS: 160 and 308; and SEQ ID NOS: 161 and 309).

TABLE 13

| SEQ ID NO | 5'Apt | 3'Apt | Linker | Sequence |
|---|---|---|---|---|
| 141 | 628 | n/a | n/a | CXAC-Z-CCGCGCGGAGGCUUGAGGUAGCCGUUUXUCX-invdT |
| 78 | 269ex | n/a | n/a | **XC**XXCXACXXUAXAUUAUGGGCAGUGUGACCXCXCC**XC**-invdT |
| 152 | 628 | 269ex | none | CXAC-Z-CCGCGCGGAGGCUUGAGGUAGCCGUUUXUCX-**XC**XXCXACXXUAXAUUAUGGGCAGUGUGACCXCXCC**XC**-invdT |
| 153 303 | 628 | 269ex | Z | CXAC-Z-CCGCGCGGAGGCUUGAGGUAGCCGUUUXUCX-Z-**XC**XXCXACXXUAXAUUAUGGGCAGUGUGACCXCXCC**XC**-invdT |

TABLE 13-continued

| SEQ ID NO | 5'Apt | 3'Apt | Linker | Sequence |
|---|---|---|---|---|
| 154 304 | 628 | 269ex | S18 | CXAC-Z-CCGCGCGGAGGCUUGAGGUAGCCGUUUXUCX-S18-**XC**XXCXACXXUAXAUUAUGGGCAGUGUGACCXCXCC**XC**-invdT |
| 155 | 628 | 269ex | 5U | CXAC-Z-CCGCGCGGAGGCUUGAGGUAGCCGUUUXUCX-UUUUU-**XC**XXCXACXXUAXAUUAUGGGCAGUGUGACCXCXCC**XC**-invdT |
| 156 | 628 | 269ex | 10U | CXAC-Z-CCGCGCGGAGGCUUGAGGUAGCCGUUUXUCX-UUUUUUUUUU-**XC**XXCXACXXUAXAUUAUGGGCAGUGUGACCXCXCC**XC**-invdT |
| 157 305 | 269ex | 628 | none | XXCXACXXUAXAUUAUGGGCAGUGUGACCXCXCC-CXAC-Z-CCGCGCGGAGGCUUGAGGUAGCCGUUUXUCX-invdT |
| 158 306 | 269ex | 628 | Z | **XC**XXCXACXXUAXAUUAUGGGCAGUGUGACCXCXCC**XC**-Z-CXAC-Z-CCGCGCGGAGGCUUGAGGUAGCCGUUUXUCX-invdT |
| 159 307 | 269ex | 628 | S18 | **XC**XXCXACXXUAXAUUAUGGGCAGUGUGACCXCXCC**XC**-S18-CXAC-Z-CCGCGCGGAGGCUUGAGGUAGCCGUUUXUCX-invdT |
| 160 308 | 269ex | 628 | 5U | **XXC**XCXACXXUAXAUUAUGGGCAGUGUGACCXCXCC**XC**-UUUUU-CXAC-Z-CCGCGCGGAGGCUUGAGGUAGCCGUUUXUCX-invdT |
| 161 309 | 269ex | 628 | 10U | **XC**XXCXACXXUAXAUUAUGGGCAGUGUGACCXCXCC**XC**-UUUUUUUUUU-CXAC-Z-CCGCGCGGAGGCUUGAGGUAGCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 14, the extended version of aptamer 628, 628ex with an inverted T (SEQ ID NO: 152) is combined with the extended version of aptamer 269, 269ex with an inverted T (SEQ ID NO: 78) using no intervening linker (SEQ ID NO: 162), a non-nucleotide linker comprised of a 3-carbon non-nucleotidyl 1,3-propanediol spacer (Z) (SEQ ID NOS: 163 and 310), a non-nucleotide linker comprised of a hexaethylene glycol spacer (S18) (SEQ ID NOS: 164 and 311), a nucleotide linker comprised of five 2'OMe deoxyuridine residues (5U) (SEQ ID NOS: 165 and 312), or a nucleotide linker comprised of ten 2'OMe deoxyuridine residues (10U) (SEQ ID NO: 166). The order of the aptamer domains is also varied (SEQ ID NOS: 167 and 313; SEQ ID NOS: 168 and 314; SEQ ID NOS: 169 and 315; SEQ ID NOS: 170 and 316; and SEQ ID NOS: 171-317).

TABLE 14

| SEQ ID NO | 5'Apt | 3'Apt | Linker | Sequence |
|---|---|---|---|---|
| 152 | 628ex | n/a | n/a | **XC**CXAC-Z-CCGCGCGGAGGCUUGAGGUAGCCGUUUXUCX**XC**-invdT |
| 78 | 269ex | n/a | n/a | **XC**XXCXACXXUAXAUUAUGGGCAGUGUGACCXCXCC**XC**-invdT |
| 162 | 628ex | 269ex | none | **XC**CXAC-Z-CCGCGCGGAGGCUUGAGGUAGCCGUUUXUCX**XC**-**XC**XXCXACXXUAXAUUAUGGGCAGUGUGACCXCXCC**XC**-invdT |
| 163 310 | 628ex | 269ex | Z | **XC**CXAC-Z-CCGCGCGGAGGCUUGAGGUAGCCGUUUXUCX**XC**-Z-**XC**XXCXACXXUAXAUUAUGGGCAGUGUGACCXCXCC**XC**-invdT |
| 164 311 | 628ex | 269ex | S18 | **XC**CXAC-Z-CCGCGCGGAGGCUUGAGGUAGCCGUUUXUCX**XC**-S18-**XC**XXCXACXXUAXAUUAUGGGCAGUGUGACCXCXCC**XC**-invdT |
| 165 312 | 628ex | 269ex | 5U | **XC**CXAC-Z-CCGCGCGGAGGCUUGAGGUAGCCGUUUXUCX**XC**-UUUUU-**XC**XXCXACXXUAXAUUAUGGGCAGUGUGACCXCXCC**XC**-invdT |
| 166 | 628ex | 269ex | 10U | **XC**CXAC-Z-CCGCGCGGAGGCUUGAGGUAGCCGUUUXUCX**XC**-UUUUUUUUUU-**XC**XXCXACXXUAXAUUAUGGGCAGUGUGACCXCXCC**XC**-invdT |
| 167 313 | 269ex | 628ex | none | **XC**XXCXACXXUAXAUUAUGGGCAGUGUGACCXCXCC**XC**-**XC**CXAC-Z-CCGCGCGGAGGCUUGAGGUAGCCGUUUXUCX**XC**-invdT |
| 168 314 | 269ex | 628ex | Z | **XC**XXCXACXXUAXAUUAUGGGCAGUGUGACCXCXCC**XC**-**XC**CXAC-Z-CCGCGCGGAGGCUUGAGGUAGCCGUUUXUCX**XC**-invdT |
| 169 315 | 269ex | 628ex | S18 | **XC**XXCXACXXUAXAUUAUGGGCAGUGUGACCXCXCC**XC**-**XC**CXAC-Z-CCGCGCGGAGGCUUGAGGUAGCCGUUUXUCX**XC**-invdT |
| 170 316 | 269ex | 628ex | 5U | **XC**XXCXACXXUAXAUUAUGGGCAGUGUGACCXCXCC**XC**-UUUUU-**XC**CXAC-Z-CCGCGCGGAGGCUUGAGGUAGCCGUUUXUCX**XC**-invdT |
| 171 317 | 269ex | 628ex | 10U | **XC**XXCXACXXUAXAUUAUGGGCAGUGUGACCXCXCC**XC**-UUUUUUUUUU-**XC**CXAC-Z-CCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 15 are bispecific aptamers generated using the anti-VEGF aptamer, aptamer 285 with an inverted T (SEQ ID NO: 55), and the anti-IL8 aptamer, aptamer 248 with an inverted T (SEQ ID NO: 172) were linked with no intervening linker (SEQ ID NO: 173), a non-nucleotide linker comprised of a 3-carbon non-nucleotidyl 1,3-propanediol spacer (Z) (SEQ ID NOS: 174 and 318), a non-nucleotide linker comprised of a hexaethylene glycol spacer (S18) (SEQ ID NOS: 175 and 319), a nucleotide linker comprised of five 2'OMe deoxyuridine residues (5U) (SEQ ID NO: 176), or a nucleotide linker comprised of ten 2'OMe deoxyuridine residues (OU) (SEQ ID NO: 177). The order of the aptamer domains is also varied (SEQ ID NOS: 178 and 320; SEQ ID NOS 179 and 321; SEQ ID NOS 180 and 322; SEQ ID NOS 181 and 323; and SEQ ID NOS 182 and 324).

TABLE 15

| SEQ ID NO | 5'Apt | 3'Apt | Linker | Sequence |
|---|---|---|---|---|
| 55 | 285 | n/a | n/a | CXAC-Z-CCGCGCGGAGGG-XUUUCAUAAUCCCGUUUXUCX-invdT |
| 172 | 248 | n/a | n/a | XCXXUGGGAAAUGUGAGAUGGGUUXCCXC-invdT |
| 173 | 285 | 248 | none | CXAC-Z-CCGCGCGGAGGGXUUUCAUAAUCCCGUUUXUCX-XCXXUGGGAAAUGUGAGAUGGGUUXCCXC-invdT |
| 174 318 | 285 | 248 | Z | CXAC-Z-CCGCGCGGAGGGXUUUCAUAAUCCCGUUUXUCX-Z-XCXXUGGGAAAUGUGAGAUGGGUUXCCXC-invdT |
| 175 319 | 285 | 248 | S18 | CXAC-Z-CCGCGCGGAGGGXUUUCAUAAUCCCGUUUXUCX-S18-XCXXUGGGAAAUGUGAGAUGGGUUXCCXC-invdT |
| 176 | 285 | 248 | 5U | CXAC-Z-CCGCGCGGAGGGXUUUCAUAAUCCCGUUUXUCX-UUUUU-XCXXUGGGAAAUGUGAGAUGGGUUXCCXC-invdT |
| 177 | 285 | 248 | 10U | CXAC-Z-CCGCGCGGAGGGXUUUCAUAAUCCCGUUUXUCX-UUUUUUUUUU-XCXXUGGGAAAUGUGAGAUGGGUUXCCXC-invdT |
| 178 320 | 248 | 285 | none | XCXXUGGGAAAUGUGAGAUGGGUUXCCXC-CXAC-Z-CCGCGCGGAGGGXUUUCAUAAUCCCGUUUXUCX-invdT |
| 179 321 | 248 | 285 | Z | XCXXUGGGAAAUGUGAGAUGGGUUXCCXC-Z-CXAC-Z-CCGCGCGGAGGGXUUUCAUAAUCCCGUUUXUCX-invdT |
| 180 322 | 248 | 285 | S18 | XCXXUGGGAAAUGUGAGAUGGGUUXCCXC-S18-CXAC-Z-CCGCGCGGAGGGXUUUCAUAAUCCCGUUUXUCX-invdT |
| 181 323 | 248 | 285 | 5U | XCXXUGGGAAAUGUGAGAUGGGUUXCCXC-UUUUU-CXAC-Z-CCGCGCGGAGGGXUUUCAUAAUCCCGUUUXUCX-invdT |
| 182 324 | 248 | 285 | 10U | XCXXUGGGAAAUGUGAGAUGGGUUXCCXC-UUUUUUUUUU-CXAC-Z-CCGCGCGGAGGGXUUUCAUAAUCCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 16, the extended version of 285, 285ex with an inverted T (SEQ ID NO: 67) can be combined with aptamer 248 with an inverted T (SEQ ID: 172) using no intervening linker (SEQ ID NO: 183), a non-nucleotide linker comprised of a 3-carbon non-nucleotidyl 1,3-propanediol spacer (Z) (SEQ ID NOS: 184 and 325), a non-nucleotide linker comprised of a hexaethylene glycol spacer (S18) (SEQ ID NOS: 185 and 326), a nucleotide linker comprised of five 2'OMe deoxyuridine residues (5U) (SEQ ID NO: 186), or a nucleotide linker comprised of ten 2'OMe deoxyuridine residues (10U) (SEQ ID NO: 187). The order of the aptamer domains is also varied (SEQ ID NOS: 188 and 327; SEQ ID NOS: 189 and 328; SEQ ID NOS: 190 and 329; SEQ ID NOS: 191 and 330; and SEQ ID NOS: 192 and 331).

TABLE 16

| SEQ ID NO | 5'Apt | 3'Apt | Linker | Sequence |
|---|---|---|---|---|
| 67 | 285ex | n/a | n/a | **XC**CXAC-Z-CCGCGCGGAGGGXUUUCAUAAUCCCGUUUXUCX**XC**-invdT |
| 172 | 248 | n/a | n/a | XCXXUGGGAAAUGUGAGAUGGGUUXCCXC-invdT |
| 183 | 285ex | 248 | none | **XC**CXAC-Z-CCGCGCGGAGGGXUUUCAUAAUCCCGUUUXUCX**XC**-XCXXUGGGAAAUGUGAGAUGGGUUXCCXC-invdT |
| 184 325 | 285ex | 248 | Z | **XC**CXAC-Z-CCGCGCGGAGGGXUUUCAUAAUCCCGUUUXUCX**XC**-Z-XCXXUGGGAAAUGUGAGAUGGGUUXCCXC-invdT |
| 185 326 | 285ex | 248 | S18 | **XC**CXAC-Z-CCGCGCGGAGGGXUUUCAUAAUCCCGUUUXUCX**XC**-S18-XCXXUGGGAAAUGUGAGAUGGGUUXCCXC-invdT |
| 186 | 285ex | 248 | 5U | **XC**CXAC-Z-CCGCGCGGAGGGXUUUCAUAAUCCCGUUUXUCX**XC**-UUUUU-XCXXUGGGAAAUGUGAGAUGGGUUXCCXC-invdT |
| 187 | 285ex | 248 | 10U | **XC**CXAC-Z-CCGCGCGGAGGGXUUUCAUAAUCCCGUUUXUCX**XC**-UUUUUUUUUU-XCXXUGGGAAAUGUGAGAUGGGUUXCCXC-invdT |

TABLE 16-continued

| SEQ ID NO | 5'Apt | 3'Apt | Linker | Sequence |
|---|---|---|---|---|
| 188 327 | 248 | 285ex | none | XCXXUGGGAAAUGUGAGAUGGGUUXCCXC-**XC**CXAC-Z-CCGCGCGGAGGGXUUUCAUAAUCCCGUUUXUCX**XC**-invdT |
| 189 328 | 248 | 285ex | Z | XCXXUGGGAAAUGUGAGAUGGGUUXCCXC-Z-**XC**CXAC-Z-CCGCGCGGAGGGXUUUCAUAAUCCCGUUUXUCX**XC**-invdT |
| 190 329 | 248 | 285ex | S18 | XCXXUGGGAAAUGUGAGAUGGGUUXCCXC-S18-**XC**CXAC-Z-CCGCGCGGAGGGXUUUCAUAAUCCCGUUUXUCX**XC**-invdT |
| 191 330 | 248 | 285ex | 5U | XCXXUGGGAAAUGUGAGAUGGGUUXCCXC-UUUUU-**XC**CXAC-Z-CCGCGCGGAGGGXUUUCAUAAUCCCGUUUXUCX**XC**-invdT |
| 192 331 | 248 | 285ex | 10U | XCXXUGGGAAAUGUGAGAUGGGUUXCCXC-UUUUUUUUUU-**XC**CXAC-Z-CCGCGCGGAGGGXUUUCAUAAUCCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 17, the extended version of 248, 248ex with an inverted T (SEQ ID NO: 193) can be combined with aptamer 285 with an inverted T (SEQ ID NO: 55) using no intervening linker (SEQ ID NO: 194), a non-nucleotide linker comprised of a 3-carbon non-nucleotidyl 1,3-propanediol spacer (Z) (SEQ ID NOS: 195 and 332), a non-nucleotide linker comprised of a hexaethylene glycol spacer (S18) (SEQ ID NOS: 196 and 333), a nucleotide linker comprised of five 2'OMe deoxyuridine residues (5U) (SEQ ID NO: 197), or a nucleotide linker comprised of ten 2'OMe deoxyuridine residues (10U) (SEQ ID NO: 198). The order of the aptamer domains is also varied (SEQ ID NOS: 199 and 334; SEQ ID NOS: 200 and 335; SEQ ID NOS: 201 and 336; SEQ ID NOS: 202 and 337; and SEQ ID NOS: 203 and 338).

TABLE 17

| SEQ ID NO | 5'Apt | 3'Apt | Linker | Sequence |
|---|---|---|---|---|
| 55 | 285 | n/a | n/a | CXAC-Z-CCGCGCGGAGGGXUUUCAUAAUCCCGUUUXUCX-invdT |
| 193 | 248ex | n/a | n/a | **XC**XCXXUGGGAAAUGUGAGAUGGGUUXCCXC**XC**-invdT |
| 194 | 285 | 248ex | none | CXAC-Z-CCGCGCGGAGGGXUUUCAUAAUCCCGUUUXUCX-**XC**XCXXUGGGAAAUGUGAGAUGGGUUXCCXC**XC**-invdT |
| 195 332 | 285 | 248ex | Z | CXAC-Z-CCGCGCGGAGGGXUUUCAUAAUCCCGUUUXUCX-Z-**XC**XCXXUGGGAAAUGUGAGAUGGGUUXCCXC**XC**-invdT |
| 196 333 | 285 | 248ex | S18 | CXAC-Z-CCGCGCGGAGGGXUUUCAUAAUCCCGUUUXUCX-S18-**XC**XCXXUGGGAAAUGUGAGAUGGGUUXCCXC**XC**-invdT |
| 197 | 285 | 248ex | 5U | CXAC-Z-CCGCGCGGAGGGXUUUCAUAAUCCCGUUUXUCX-UUUUU-**XC**XCXXUGGGAAAUGUGAGAUGGGUUXCCXC**XC**-invdT |
| 198 | 285 | 248ex | 10U | CXAC-Z-CCGCGCGGAGGGXUUUCAUAAUCCCGUUUXUCX-UUUUUUUUUU-**XC**XCXXUGGGAAAUGUGAGAUGGGUUXCCXC**XC**-invdT |
| 199 334 | 248ex | 285 | none | **XC**XCXXUGGGAAAUGUGAGAUGGGUUXCCXC**XC**-CXAC-Z-CCGCGCGGAGGGXUUUCAUAAUCCCGUUUXUCX-invdT |
| 200 335 | 248ex | 285 | Z | **XC**XCXXUGGGAAAUGUGAGAUGGGUUXCCXC**XC**-Z-CXAC-Z-CCGCGCGGAGGGXUUUCAUAAUCCCGUUUXUCX-invdT |
| 201 336 | 248ex | 285 | S18 | **XC**XCXXUGGGAAAUGUGAGAUGGGUUXCCXC**XC**-S18-CXAC-Z-CCGCGCGGAGGGXUUUCAUAAUCCCGUUUXUCX-invdT |
| 202 337 | 248ex | 285 | 5U | **XC**XCXXUGGGAAAUGUGAGAUGGGUUXCCXC**XC**-UUUUU-CXAC-Z-CCGCGCGGAGGGXUUUCAUAAUCCCGUUUXUCX-invdT |
| 203 338 | 248ex | 285 | 10U | **XC**XCXXUGGGAAAUGUGAGAUGGGUUXCCXC**XC**-UUUUUUUUUU-CXAC-Z-CCGCGCGGAGGGXUUUCAUAAUCCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 18, the extended version of 285, 285ex with an inverted T (SEQ ID NO: 67) can be combined with the extended version of aptamer 248, 248ex with an inverted T (SEQ ID NO: 193) using no intervening linker (SEQ ID NO: 204), a non-nucleotide linker comprised of a 3-carbon non-nucleotidyl 1,3-propanediol spacer (Z) (SEQ ID NOS: 205 and 339), a non-nucleotide linker comprised of a hexaethylene glycol spacer (S18) (SEQ ID NOS: 206 and 340), a nucleotide linker comprised of five 2'OMe deoxyuridine residues (5U) (SEQ ID NO: 207), or a nucleotide linker comprised of ten 2'OMe deoxyuridine residues (10U) (SEQ ID NO: 208). The order of the aptamer is also varied (SEQ ID NOS: 209 and 341; SEQ ID NOS: 210 and 342: SEQ ID NOS: 211 and 343; SEQ ID NOS: 212 and 344; and SEQ ID NOS: 213 and 345).

TABLE 18

| SEQ ID NO | 5'Apt | 3'Apt | Linker | Sequence |
|---|---|---|---|---|
| 67 | 285ex | n/a | n/a | **XC**CXAC-Z-CCGCGCGGAGGGXUUUCAUAAUCCCGUUUXUCX**XC**-invdT |

TABLE 18-continued

| SEQ ID NO | 5'Apt | 3'Apt | Linker | Sequence |
|---|---|---|---|---|
| 193 | 248ex | n/a | n/a | **XC**XCXXUGGGAAAUGUGAGAUGGGUUXCCXC**XC**-invdT |
| 204 | 285ex | 248ex | none | **XC**CXAC-Z-CCGCGCGGAGGGXUUUCAUAAUCCCGUUUXUCX**XC**-**XC**XCXXUGGGAAAUGUGAGAUGGGUUXCCXC**XC**-invdT |
| 205<br>339 | 285ex | 248ex | Z | **XC**CXAC-Z-CCGCGCGGAGGGXUUUCAUAAUCCCGUUUXUCX**XC**-Z-**XC**XCXXUGGGAAAUGUGAGAUGGGUUXCCXC**XC**-invdT |
| 206<br>340 | 285ex | 248ex | S18 | **XC**CXAC-Z-CCGCGCGGAGGGXUUUCAUAAUCCCGUUUXUCX**XC**-S18-**XC**XCXXUGGGAAAUGUGAGAUGGGUUXCCXC**XC**-invdT |
| 207 | 285ex | 248ex | 5U | **XC**CXAC-Z-CCGCGCGGAGGGXUUUCAUAAUCCCGUUUXUCX**XC**-UUUUU-**XC**XCXXUGGGAAAUGUGAGAUGGGUUXCCXC**XC**-invdT |
| 208 | 285ex | 248ex | 10U | **XC**CXAC-Z-CCGCGCGGAGGGXUUUCAUAAUCCCGUUUXUCX**XC**-UUUUUUUUUU-**XC**XCXXUGGGAAAUGUGAGAUGGGUUXCCXC**XC**-invdT |
| 209<br>341 | 248ex | 285ex | none | **XC**XCXXUGGGAAAUGUGAGAUGGGUUXCCXC**XC**-**XC**CXAC-Z-CCGCGCGGAGGGXUUUCAUAAUCCCGUUUXUCX**XC**-invdT |
| 210<br>342 | 248ex | 285ex | Z | **XC**XCXXUGGGAAAUGUGAGAUGGGUUXCCXC**XC**-Z-**XC**CXAC-Z-CCGCGCGGAGGGXUUUCAUAAUCCCGUUUXUCX**XC**-invdT |
| 211<br>343 | 248ex | 285ex | S18 | **XC**XCXXUGGGAAAUGUGAGAUGGGUUXCCXC**XC**-S18-**XC**CXAC-Z-CCGCGCGGAGGGXUUUCAUAAUCCCGUUUXUCX**XC**-invdT |
| 212<br>344 | 248ex | 285ex | 5U | **XC**XCXXUGGGAAAUGUGAGAUGGGUUXCCXC**XC**-UUUUU-**XC**CXAC-Z-CCGCGCGGAGGGXUUUCAUAAUCCCGUUUXUCX**XC**-invdT |
| 213<br>345 | 248ex | 285ex | 10U | **XC**XCXXUGGGAAAUGUGAGAUGGGUUXCCXC**XC**-UUUUUUUUUU-**XC**CXAC-Z-CCGCGCGGAGGGXUUUCAUAAUCCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Bispecific aptamer designs were extended to include other variants of aptamer 285 which were identified during a selection in which the Loop 4 of the aptamer was randomized. Shown in Table 19 are examples of bispecific aptamers sequences using anti-VEGF aptamer, aptamer 481 with an inverted T (SEQ ID NO: 99), and the anti-IL8 aptamer, aptamer 248 with an inverted T (SEQ ID NO: 172) linked with no intervening linker (SEQ ID NO: 214), a non-nucleotide linker comprised of a 3-carbon non-nucleotidyl 1,3-propanediol spacer (Z) (SEQ ID NO: 215 and 346), a non-nucleotide linker comprised of a hexaethylene glycol spacer (S18) (SEQ ID NOS: 216 and 347), a nucleotide linker comprised of five 2' OMe deoxyuridine residues (5U) (SEQ ID NO: 217), or a nucleotide linker comprised of ten 2'OMe deoxyuridine residues (10U) (SEQ ID NO: 218). The order of the aptamer domains is also varied (SEQ ID NO: 219; SEQ ID NOS: 220, 348, 349, and 350; and SEQ ID NOS: 221-223).

TABLE 19

| SEQ ID NO | 5'Apt | 3'Apt | Linker | Sequence |
|---|---|---|---|---|
| 99 | 481 | n/a | n/a | CXACUCCGCGCGGAGGCUUGAGGUAGCCGUUUXUCX-invdT |
| 172 | 248 | n/a | n/a | XCXXUGGGAAAUGUGAGAUGGGUUXCCXC-invdT |
| 214 | 481 | 248 | none | CXACUCCGCGCGGAGGCUUGAGGUAGCCGUUUXUCX-XCXXUGGGAAAUGUGAGAUGGGUUXCCXC-invdT |
| 215<br>346 | 481 | 248 | Z | CXACUCCGCGCGGAGGCUUGAGGUAGCCGUUUXUCX-Z-XCXXUGGGAAAUGUGAGAUGGGUUXCCXC-invdT |
| 216<br>347 | 481 | 248 | S18 | CXACUCCGCGCGGAGGCUUGAGGUAGCCGUUUXUCX-S18-XCXXUGGGAAAUGUGAGAUGGGUUXCCXC-invdT |
| 217 | 481 | 248 | 5U | CXACUCCGCGCGGAGGCUUGAGGUAGCCGUUUXUCX-UUUUU-XCXXUGGGAAAUGUGAGAUGGGUUXCCXC-invdT |
| 218 | 285 | 248 | 10U | CXACUCCGCGCGGAGGCUUGAGGUAGCCGUUUXUCX-UUUUUUUUUU-XCXXUGGGAAAUGUGAGAUGGGUUXCCXC-invdT |
| 219 | 248 | 481 | none | XCXXUGGGAAAUGUGAGAUGGGUUXCCXC-CXACUCCGCGCGGAGGCUUGAGGUAGCCGUUUXUCX-invdT |
| 220<br>348<br>349<br>350 | 248 | 481 | Z | XCXXUGGGAAAUGUGAGAUGGGUUXCCXC-Z-CXACUCCGCGCGGAGGCUUGAGGUAGCCGUUUXUCX-invdT<br>XCXXUGGGAAAUGUGAGAUGGGUUXCCXC-S18-CXACUCCGCGCGGAGGCUUGAGGUAGCCGUUUXUCX-invdT |
| 221 | 248 | 481 | S18 | XCXXUGGGAAAUGUGAGAUGGGUUXCCXC-UUUUU-CXACUCCGCGCGGAGGCUUGAGGUAGCCGUUUXUCX-invdT |
| 222 | 248 | 481 | 5U | XCXXUGGGAAAUGUGAGAUGGGUUXCCXC-UUUUUUUUUU-CXACUCCGCGCGGAGGCUUGAGGUAGCCGUUUXUCX-invdT |
| 223 | 248 | 481 | 10U | XCXXUGGGAAAUGUGAGAUGGGUUXCCXC-CXACUCCGCGCGGAGGCUUGAGGUAGCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 20, an extended version of aptamer 48, 481ex with an inverted T (SEQ ID NO: 110) that contains two additional base pairs to stabilize the closing stem is combined with aptamer 248 (SEQ ID NO: 172) using no intervening linker (SEQ ID NO: 224), a non-nucleotide linker comprised of a 3-carbon non-nucleotidyl 1,3-propanediol spacer (Z) (SEQ ID NOS: 225 and 351), a non-nucleotide linker comprised of a hexaethylene glycol spacer (S18) (SEQ ID NOS: 226 and 352), a nucleotide linker comprised of five 2'OMe deoxyuridine residues (5U) (SEQ ID NO: 227), or a nucleotide linker comprised of ten 2'OMe deoxyuridine residues (OU) (SEQ ID NO: 228). The order of the aptamer domains is also varied (SEQ ID NO: 229; SEQ ID NOS: 230 and 353; SEQ ID NOS: 231 and 354; and SEQ ID NOS: 232-233).

TABLE 20

| SEQ ID NO | 5'Apt | 3'Apt | Linker | Sequence |
|---|---|---|---|---|
| 110 | 481ex | n/a | n/a | **XC**CXACUCCGCGCGGAGGCUUGAGGUAGCCGUUUXUCX**XC**-invdT |
| 172 | 248 | n/a | n/a | XCXXUGGGAAAUGUGAGAUGGGUUXCCXC-invdT |
| 224 | 481ex | 248 | none | **XC**CXACUCCGCGCGGAGGCUUGAGGUAGCCGUUUXUCX**XC**-XCXXUGGGAAAUGUGAGAUGGGUUXCCXC-invdT |
| 225<br>351 | 481ex | 248 | Z | **XC**CXACUCCGCGCGGAGGCUUGAGGUAGCCGUUUXUCX**XC**-Z-XCXXUGGGAAAUGUGAGAUGGGUUXCCXC-invdT |
| 226<br>352 | 481ex | 248 | S18 | **XC**CXACUCCGCGCGGAGGCUUGAGGUAGCCGUUUXUCX**XC**-S18-XCXXUGGGAAAUGUGAGAUGGGUUXCCXC-invdT |
| 227 | 481ex | 248 | 5U | **XC**CXACUCCGCGCGGAGGCUUGAGGUAGCCGUUUXUCX**XC**-UUUUU-XCXXUGGGAAAUGUGAGAUGGGUUXCCXC-invdT |
| 228 | 481ex | 248 | 10U | **XC**CXACUCCGCGCGGAGGCUUGAGGUAGCCGUUUXUCX**XC**-UUUUUUUUUU-XCXXUGGGAAAUGUGAGAUGGGUUXCCXC-invdT |
| 229 | 248 | 481ex | none | XCXXUGGGAAAUGUGAGAUGGGUUXCCXC-**XC**CXACUCCGCGCGGAGGCUUGAGGUAGCCGUUUXUCX**XC**-invdT |
| 230<br>353 | 248 | 481ex | Z | XCXXUGGGAAAUGUGAGAUGGGUUXCCXC-Z-**XC**CXACUCCGCGCGGAGGCUUGAGGUAGCCGUUUXUCX**XC**-invdT |
| 231<br>354 | 248 | 481ex | S18 | XCXXUGGGAAAUGUGAGAUGGGUUXCCXC-S18-**XC**CXACUCCGCGCGGAGGCUUGAGGUAGCCGUUUXUCX**XC**-invdT |
| 232 | 248 | 481ex | 5U | XCXXUGGGAAAUGUGAGAUGGGUUXCCXC-UUUUU-**XC**CXACUCCGCGCGGAGGCUUGAGGUAGCCGUUUXUCX**XC**-invdT |

TABLE 20-continued

| SEQ ID NO | 5'Apt | 3'Apt | Linker | Sequence |
|---|---|---|---|---|
| 233 | 248 | 481ex | 10U | XCXXUGGGAAAUGUGAGAUGGGUUXCCXC-UUUUUUUUUU-**XC**CXACUCCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 21, the extended version of 248, 248ex with an inverted T (SEQ ID NO: 193) is combined with aptamer 481 with an inverted T (SEQ ID NO: 99) using no intervening linker (SEQ ID NO: 234), a non-nucleotide linker comprised of a 3-carbon non-nucleotidyl 1,3-propanediol spacer (Z) (SEQ ID NOS: 235 and 355), a non-nucleotide linker comprised of a hexaethylene glycol spacer (S18) (SEQ ID NOS: 236 and 356), a nucleotide linker comprised of five 2'OMe deoxyuridine residues (5U) (SEQ ID NO: 237), or a nucleotide linker comprised of ten 2'OMe deoxyuridine residues (10U) (SEQ ID NO: 238). The order of the aptamer domains is also varied (SEQ ID NO: 239; SEQ ID NOS: 240 and 357; SEQ ID NOS: 241 and 358; SEQ ID NOS: 242-243).

TABLE 21

| SEQ ID NO | 5'Apt | 3'Apt | Linker | Sequence |
|---|---|---|---|---|
| 99 | 481 | n/a | n/a | CXACUCCGCGCGGAGGCUUGAGGUAGCCGUUUXUCX-invdT |
| 193 | 248ex | n/a | n/a | **XC**XCXXUGGGAAAUGUGAGAUGGGUUXCCXC**XC**-invdT |
| 234 | 481 | 248ex | none | CXACUCCGCGCGGAGGCUUGAGGUAGCCGUUUXUCX-**XC**XCXXUGGGAAAUGUGAGAUGGGUUXCCXC**XC**-invdT |
| 235<br>355 | 481 | 248ex | Z | CXACUCCGCGCGGAGGCUUGAGGUAGCCGUUUXUCX-Z-**XC**XCXXUGGGAAAUGUGAGAUGGGUUXCCXC**XC**-invdT |
| 236<br>356 | 481 | 248ex | S18 | CXACUCCGCGCGGAGGCUUGAGGUAGCCGUUUXUCX-S18-**XC**XCXXUGGGAAAUGUGAGAUGGGUUXCCXC**XC**-invdT |
| 237 | 481 | 248ex | 5U | CXACUCCGCGCGGAGGCUUGAGGUAGCCGUUUXUCX-UUUUU-**XC**XCXXUGGGAAAUGUGAGAUGGGUUXCCXC**XC**-invdT |
| 238 | 481 | 248ex | 10U | CXACUCCGCGCGGAGGCUUGAGGUAGCCGUUUXUCX-UUUUUUUUUU-**XC**XCXXUGGGAAAUGUGAGAUGGGUUXCCXC**XC**-invdT |
| 239 | 248ex | 481 | none | XCXXUGGGAAAUGUGAGAUGGGUUXCCXC-**XC**CXACUCCGCGCGGAGGCUUGAGGUAGCCGUUUXUCX**XC**-invdT |
| 240<br>357 | 248ex | 481 | Z | XCXXUGGGAAAUGUGAGAUGGGUUXCCXC-Z-**XC**CXACUCCGCGCGGAGGCUUGAGGUAGCCGUUUXUCX**XC**-invdT |

TABLE 21-continued

| SEQ ID NO | 5'Apt | 3'Apt | Linker | Sequence |
|---|---|---|---|---|
| 241 358 | 248ex | 481 | S18 | XCXXUGGGAAAUGUGAGAUGGGUUXCCXC-S18-**XC**CXACUCCGCGCGGAGGCUUGAGGUAGCCGUUUXUCX**XC**-invdT |
| 242 | 248ex | 481 | 5U | XCXXUGGGAAAUGUGAGAUGGGUUXCCXC-UUUUU-**XC**CXACUCCGCGCGGAGGCUUGAGGUAGCCGUUUXUCX**XC**-invdT |
| 243 | 248ex | 481 | 10U | XCXXUGGGAAAUGUGAGAUGGGUUXCCXC-UUUUUUUUUU-**XC**CXACUCCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 22, the extended version of 481, 481ex with an inverted T (SEQ ID NO: 110) is combined with the extended version of aptamer 248, 248ex with an inverted T (SEQ ID NO: 193) using no intervening linker (SEQ ID NO: 244), a non-nucleotide linker comprised of a 3-carbon non-nucleotidyl 1,3-propanediol spacer (Z) (SEQ ID NOS: 245 and 359), a non-nucleotide linker comprised of a hexaethylene glycol spacer (S18) (SEQ ID NOS: 246 and 360), a nucleotide linker comprised of five 2'OMe deoxyuridine residues (5U) (SEQ ID NO: 247), or a nucleotide linker comprised of ten 2'OMe deoxyuridine residues (10U) (SEQ ID NO: 248). The order of the aptamer domains is also varied (SEQ ID NOS: 249-253).

TABLE 22

| SEQ ID NO | 5'Apt | 3'Apt | Linker | Sequence |
|---|---|---|---|---|
| 110 | 481ex | n/a | n/a | **XC**CXACUCCGCGCGGAGGCUUGAGGUAGCCGUUUXUCX**XC**-invdT |
| 193 | 248ex | n/a | n/a | **XC**XCXXUGGGAAAUGUGAGAUGGGUUXCCXC**XC**-invdT |
| 244 | 481ex | 248ex | none | **XC**CXACUCCGCGCGGAGGCUUGAGGUAGCCGUUUXUCX**XC**-**XC**XCXXUGGGAAAUGUGAGAUGGGUUXCCXC**XC**-invdT |
| 245 359 | 481ex | 248ex | Z | **XC**CXACUCCGCGCGGAGGCUUGAGGUAGCCGUUUXUCX**XC**-Z-**XC**XCXXUGGGAAAUGUGAGAUGGGUUXCCXC**XC**-invdT |
| 246 360 | 481ex | 248ex | S18 | **XC**CXACUCCGCGCGGAGGCUUGAGGUAGCCGUUUXUCX**XC**-S18-**XC**XCXXUGGGAAAUGUGAGAUGGGUUXCCXC**XC**-invdT |
| 247 | 481ex | 248ex | 5U | **XC**CXACUCCGCGCGGAGGCUUGAGGUAGCCGUUUXUCX**XC**-UUUUU-**XC**XCXXUGGGAAAUGUGAGAUGGGUUXCCXC**XC**-invdT |
| 248 | 481ex | 248ex | 10U | **XC**CXACUCCGCGCGGAGGCUUGAGGUAGCCGUUUXUCX**XC**-UUUUUUUUUU-**XC**XCXXUGGGAAAUGUGAGAUGGGUUXCCXC**XC**-invdT |

TABLE 22-continued

| SEQ ID NO | 5'Apt | 3'Apt | Linker | Sequence |
|---|---|---|---|---|
| 249 | 248ex | 481ex | none | **XC**XCXXUGGGAAAUGUGAGAUGGGUUXCCXC**XC**-**XC**CXACUCCGCGCGGAGGCUUGAGGUAGCCGUUUXUCX**XC**-invdT |
| 250 | 248ex | 481ex | Z | **XC**XCXXUGGGAAAUGUGAGAUGGGUUXCCXC**XC**-**XC**CXACUCCGCGCGGAGGCUUGAGGUAGCCGUUUXUCX**XC**-invdT |
| 251 | 248ex | 481ex | S18 | **XC**XCXXUGGGAAAUGUGAGAUGGGUUXCCXC**XC**-**XC**CXACUCCGCGCGGAGGCUUGAGGUAGCCGUUUXUCX**XC**-invdT |
| 252 | 248ex | 481ex | 5U | **XC**XCXXUGGGAAAUGUGAGAUGGGUUXCCXC**XC**-UUUUU-**XC**CXACUCCGCGCGGAGGCUUGAGGUAGCCGUUUXUCX**XC**-invdT |
| 253 | 248ex | 481ex | 10U | **XC**XCXXUGGGAAAUGUGAGAUGGGUUXCCXC**XC**-UUUUUUUUUU-**XC**CXACUCCGCGCGGAGGCUUGAGGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Aptamer 628 (SEQ ID NO: 141) is a variant of aptamer 481 in which the U at position 5 relative to the start of aptamer 285 has been replaced with a Z non-nucleotidyl linker. Shown in Table 23 are examples of bispecific aptamers sequences generated using anti-VEGF aptamer, aptamer 628 with an inverted T (SEQ ID NO: 141), and the anti-IL8 aptamer, aptamer 248 with an inverted T (SEQ ID NO: 172) linked with no intervening linker (SEQ ID NO: 254), a non-nucleotide linker comprised of a 3-carbon non-nucleotidyl 1,3-propanediol spacer (Z) (SEQ ID NOS: 255 and 362), a non-nucleotide linker comprised of a hexaethylene glycol spacer (S18) (SEQ ID NOS: 256 and 363), a nucleotide linker comprised of five 2'OMe deoxyuridine residues (5U) (SEQ ID NO: 257), or a nucleotide linker comprised of ten 2'OMe deoxyuridine residues (10U) (SEQ ID NO: 258). The order of the aptamer domains is also varied (SEQ ID NOS: 259 and 364; SEQ ID NOS: 260 and 365; SEQ ID NOS: 261 and 366; SEQ ID NOS: 262 and 367; SEQ ID NOS: 263 and -368).

TABLE 23

| SEQ ID NO | 5'Apt | 3'Apt | Linker | Sequence |
|---|---|---|---|---|
| 141 | 628 | n/a | n/a | CXAC-Z-CCGCGCGGAGGCUUGAGGUAGCCGUUUXUCX-invdT |
| 172 | 248 | n/a | n/a | XCXXUGGGAAAUGUGAGAUGGGUUXCCXC-invdT |
| 254 | 628 | 248 | none | CXAC-Z-CCGCGCGGAGGCUUGAGGUAGCCGUUUXUCX-XCXXUGGGAAAUGUGAGAUGGGUUXCCXC-invdT |
| 255 362 | 628 | 248 | Z | CXAC-Z-CCGCGCGGAGGCUUGAGGUAGCCGUUUXUCX-Z-XCXXUGGGAAAUGUGAGAUGGGUUXCCXC-invdT |

TABLE 23-continued

| SEQ ID NO | 5'Apt | 3'Apt | Linker | Sequence |
|---|---|---|---|---|
| 256 363 | 628 | 248 | S18 | CXAC-Z-CCGCGCGGAGGCUUG AGGUAGCCGUUUXUCX-S18-X CXXUGGGAAAUGUGAGAUGGGU UXCCXC-invdT |
| 257 | 628 | 248 | 5U | CXAC-Z-CCGCGCGGAGGCUUG AGGUAGCCGUUUXUCX-UUUUU-XCXXUGGGAAAUGUGAGAUGGG UUXCCXC-invdT |
| 258 | 628 | 248 | 10U | CXAC-Z-CCGCGCGGAGGCUUG AGGUAGCCGUUUXUCX-UUUUU UUUUU-XCXXUGGGAAAUGUGA GAUGGGUUXCCXC-invdT |
| 259 364 | 248 | 628 | none | XCXXUGGGAAAUGUGAGAUGGG UUXCCXC-CXAC-Z-CCGCGCG GAGGCUUGAGGUAGCCGUUUXU CX-invdT |
| 260 365 | 248 | 628 | Z | XCXXUGGGAAAUGUGAGAUGGG UUXCCXC-Z-CXAC-Z-CCGCG CGGAGGCUUGAGGUAGCCGUUU XUCX-invdT |
| 261 366 | 248 | 628 | S18 | XCXXUGGGAAAUGUGAGAUGGG UUXCCXC-S18-CXAC-Z-CCG CGCGGAGGCUUGAGGUAGCCGU UUXUCX-invdT |
| 262 367 | 248 | 628 | 5U | XCXXUGGGAAAUGUGAGAUGGG UUXCCXC-UUUUU-CXAC-Z-C CGCGCGGAGGCUUGAGGUAGCC GUUUXUCX-invdT |
| 263 368 | 248 | 628 | 10U | XCXXUGGGAAAUGUGAGAUGGG UUXCCXC-UUUUUUUUUU-CXA C-Z-CCGCGCGGAGGCUUGAGG UAGCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.

Sequences in bold indicate base pairs added to stabilize a terminal stem and a dash (-) is used to flank the linker.

Shown in Table 24, an extended version of aptamer 628, 628ex with an inverted T (SEQ ID NO: 152) that contains two additional base pairs to stabilize the closing stem is combined with aptamer 248 with an inverted T (SEQ ID NO: 172) using no intervening linker (SEQ ID NO: 264), a non-nucleotide linker comprised of a 3-carbon non-nucleotidyl 1,3-propanediol spacer (Z) (SEQ ID NOS: 265 and 369), a non-nucleotide linker comprised of a hexaethylene glycol spacer (S18) (SEQ ID NOS: 266 and 370), a nucleotide linker comprised of five 2'OMe deoxyuridine residues (5U) (SEQ ID NO: 267), or a nucleotide linker comprised of ten 2'OMe deoxyuridine residues (10U) (SEQ ID NO: 268). The order of the aptamer domains is also varied (SEQ ID NOS: 269 and 371; SEQ ID NOS: 270 and 372; SEQ ID NOS: 271 and 373; SEQ ID NOS: 272 and 374; SEQ ID NOS: 273 and 375).

TABLE 24

| SEQ ID NO | 5'Apt | 3'Apt | Linker | Sequence |
|---|---|---|---|---|
| 152 | 628ex | n/a | n/a | CXAC-Z-CCGCGCGGAGGCUUG AGGUAGCCGUUUXUCX-invdT |
| 172 | 248 | n/a | n/a | XCXXUGGGAAAUGUGAGAUGGG UUXCCXC-invdT |
| 264 | 628ex | 248 | none | **XC**CXAC-Z-CCGCGCGGAGGCUUGAGGUAGC CGUUUXUCX**XC**-XCXXUGGGAA AUGUGAGAUGGGUUXCCXC-invdT |
| 265 369 | 628ex | 248 | Z | **XC**CXAC-Z-CCGCGCGGAGGCUUGAGGUAGC CGUUUXUCX**XC**-Z-XCXXUGGG AAAUGUGAGAUGGGUUXCCXC-invdT |
| 266 370 | 628ex | 248 | S18 | **XC**CXAC-Z-CCGCGCGGAGGCUUGAGGUAGC CGUUUXUCX**XC**-S18-XCXXUG GGAAAUGUGAGAUGGGUUXCCX C-invdT |
| 267 | 628ex | 248 | 5U | **XC**CXAC-Z-CCGCGCGGAGGCUUGAGGUAGC CGUUUXUCX**XC**-UUUUU-XCXX UGGGAAAUGUGAGAUGGGUUXC CXC-invdT |
| 268 | 628ex | 248 | 10U | **XC**CXAC-Z-CCGCGCGGAGGCUUGAGGUAGC CGUUUXUCX**XC**-UUUUUUUUUU-XCXXUGGGAAAUGUGAGAUGGG UUXCCXC-invdT |
| 269 371 | 248 | 628ex | none | XCXXUGGGAAAUGUGAGAUGGG UUXCCXC-**XC**CXAC-Z-CCGCG CGGAGGCUUGAGGUAGCCGUUU XUCX**XC**-invdT |
| 270 372 | 248 | 628ex | Z | XCXXUGGGAAAUGUGAGAUGGG UUXCCXC-Z-**XC**CXAC-Z-CCG CGCGGAGGCUUGAGGUAGCCGU UUXUCX**XC**-invdT |
| 271 373 | 248 | 628ex | S18 | XCXXUGGGAAAUGUGAGAUGGG UUXCCXC-S18-**XC**CXAC-Z-C CGCGCGGAGGCUUGAGGUAGCC GUUUXUCX**XC**-invdT |
| 272 374 | 248 | 628ex | 5U | XCXXUGGGAAAUGUGAGAUGGG UUXCCXC-UUUUU-**XC**CXAC-Z-CCGCGCGGAGGCUUGAGGUAGC CGUUUXUCX**XC**-invdT |
| 273 375 | 248 | 628ex | 10U | XCXXUGGGAAAUGUGAGAUGGG UUXCCXC-UUUUUUUUUU-**XC**C XAC-Z-CCGCGCGGAGGCUUGA GGUAGCCGUUUXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.

Sequences in bold indicate base pairs added to stabilize a terminal stem and a dash (-) is used to flank the linker.

Shown in Table 25, the extended version of 248, 248ex with an inverted T (SEQ ID NO: 193) is combined with aptamer 628 with an inverted T (SEQ ID NO: 141) using no intervening linker (SEQ ID NO: 274), a non-nucleotide linker comprised of a 3-carbon non-nucleotidyl 1,3-propanediol spacer (Z) (SEQ ID NOS: 275 and 376), a non-nucleotide linker comprised of a hexaethylene glycol spacer (S18) (SEQ ID NOS: 276 and 377), a nucleotide linker comprised of five 2'OMe deoxyuridine residues (5U) (SEQ ID NO: 277), or a nucleotide linker comprised of ten 2'OMe deoxyuridine residues (10U) (SEQ ID NO: 278). The order of the aptamer domains is also varied (SEQ ID NOS: 279 and 378; SEQ ID NOS: 280 and 379; SEQ ID NOS: 281 and 380; SEQ ID NOS: 282 and 381; SEQ ID NOS: 283 and 382).

TABLE 25

| SEQ ID NO | 5'Apt | 3'Apt | Linker | Sequence |
|---|---|---|---|---|
| 141 | 628 | n/a | n/a | CXAC-Z-CCGCGCGGAGGCUUG AGGUAGCCGUUUXUCX-invdT |
| 193 | 248ex | n/a | n/a | **XC**XCXXUGGGAAAUGUGAGAUG GGUUXCCXC**XC**-invdT |
| 274 | 628 | 248ex | none | CXAC-Z-CCGCGCGGAGGCUUG AGGUAGCCGUUUXUCX-**XC**XCX XUGGGAAAUGUGAGAUGGGUUX CCXC**XC**-invdT |
| 275 376 | 628 | 248ex | Z | CXAC-Z-CCGCGCGGAGGCUUG AGGUAGCCGUUUXUCX-Z-**XC**X CXXUGGGAAAUGUGAGAUGGGU UXCCXC**XC**-invdT |
| 276 377 | 628 | 248ex | S18 | CXAC-Z-CCGCGCGGAGGCUUG AGGUAGCCGUUUXUCX-S18-**X** **C**XCXXUGGGAAAUGUGAGAUGG GUUXCCXC**XC**-invdT |
| 277 | 628 | 248ex | 5U | CXAC-Z-CCGCGCGGAGGCUUG AGGUAGCCGUUUXUCX-UUUUU- **XC**XCXXUGGGAAAUGUGAGAUG GGUUXCCXC**XC**-invdT |
| 278 | 628 | 248ex | 10U | CXAC-Z-CCGCGCGGAGGCUUG AGGUAGCCGUUUXUCX-UUUUU UUUUU-**XC**XCXXUGGGAAAUGU GAGAUGGGUUXCCXC**XC**- invdT |
| 279 378 | 248ex | 628 | none | XCXXUGGGAAAUGUGAGAUGGG UUXCCXC-CXAC-Z-CCGCGCG GAGGCUUGAGGUAGCCGUUUXU CX-invdT |
| 280 379 | 248ex | 628 | Z | **XC**XCXXUGGGAAAUGUGAGAUG GGUUXCCXC**XC**-Z-CXAC-Z-C CGCGCGGAGGCUUGAGGUAGCC GUUUXUCX-invdT |
| 281 380 | 248ex | 628 | S18 | **XC**XCXXUGGGAAAUGUGAGAUG GGUUXCCXC**XC**-S18-CXAC-Z- CCGCGCGGAGGCUUGAGGUAGC CGUUUXUCX-invdT |
| 282 381 | 248ex | 628 | 5U | X**XC**XCXACXXUAXAUUAUGGGC AGUGUGACCXCXCC**XC**-UUUUU- CXAC-Z-CCGCGCGGAGGCUUG AGGUAGCCGUUUXUCX-invdT |
| 283 382 | 248ex | 628 | 10U | **XC**XCXXUGGGAAAUGUGAGAUG GGUUXCCXC**XC**-UUUUUUUUUU- CXAC-Z-CCGCGCGGAGGCUUG AGGUAGCCGUUUXUCX-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

Shown in Table 26, the extended version of aptamer 628, 628ex with an inverted T (SEQ ID NO: 152) is combined with the extended version of aptamer 248, 248ex with an inverted T (SEQ ID NO: 193) using no intervening linker (SEQ ID NO: 284), a non-nucleotide linker comprised of a 3-carbon non-nucleotidyl 1,3-propanediol spacer (Z) (SEQ ID NOS: 285 and 383), a non-nucleotide linker comprised of a hexaethylene glycol spacer (S18) (SEQ ID NOS: 286 and 384), a nucleotide linker comprised of five 2'OMe deoxyuridine residues (5U) (SEQ ID NO: 287), or a nucleotide linker comprised of ten 2'OMe deoxyuridine residues (10U) (SEQ ID NO: 288). The order of the aptamer domains is also varied (SEQ ID NOS: 289 and 385; SEQ ID NOS: 290 and 386; SEQ ID NOS: 291 and 387; SEQ ID NOS: 292 and 388; SEQ ID NOS: 293 and 389).

TABLE 26

| SEQ ID NO | 5'Apt | 3'Apt | Linker | Sequence |
|---|---|---|---|---|
| 152 | 628ex | n/a | n/a | **XC**CXAC-Z- CCGCGCGGAGGCUUGAGGUA GCCGUUUXUCX**XC**-invdT |
| 193 | 248ex | n/a | n/a | **XC**XCXXUGGGAAAUGUGAGA UGGGUUXCCXC**XC**-invdT |
| 284 | 628ex | 248ex | none | **XC**CXAC-Z- CCGCGCGGAGGCUUGAGGUA GCCGUUUXUCX**XC**-**XC**XCXX UGGGAAAUGUGAGAUGGGUU XCCXC**XC**-invdT |
| 285 383 | 628ex | 248ex | Z | **XC**CXAC-Z- CCGCGCGGAGGCUUGAGGUA GCCGUUUXUCX**XC**-Z-**XC**XC XXUGGGAAAUGUGAGAUGGG UUXCCXC**XC**-invdT |
| 286 384 | 628ex | 248ex | S18 | **XC**CXAC-Z- CCGCGCGGAGGCUUGAGGUA GCCGUUUXUCX**XC**-S18-**XC** XCXXUGGGAAAUGUGAGAUG GGUUXCCXC**XC**-invdT |
| 287 | 628ex | 248ex | 5U | **XC**CXAC-Z- CCGCGCGGAGGCUUGAGGUA GCCGUUUXUCX**XC**-UUUUU- **XC**XCXXUGGGAAAUGUGAGA UGGGUUXCCXC**XC**-invdT |
| 288 | 628ex | 248ex | 10U | **XC**CXAC-Z- CCGCGCGGAGGCUUGAGGUA GCCGUUUXUCX**XC**-UUUUUU UUUU-**XC**XCXXUGGGAAAUG UGAGAUGGGUUXCCXC**XC**- invdT |
| 289 385 | 248ex | 628ex | none | **XC**XCXXUGGGAAAUGUGAGA UGGGUUXCCXC**XC**-**XC**CXAC- Z-CCGCGCGGAGGCUUGAGG UAGCCGUUUXUCX**XC**- invdT |
| 290 386 | 248ex | 628ex | Z | **XC**XCXXUGGGAAAUGUGAGA UGGGUUXCCXC**XC**-**XC**CXAC- Z-CCGCGCGGAGGCUUGAGG UAGCCGUUUXUCX**XC**- invdT |
| 291 387 | 248ex | 628ex | S18 | **XC**XCXXUGGGAAAUGUGAGA UGGGUUXCCXC**XC**-**XC**CXAC- Z-CCGCGCGGAGGCUUGAGG UAGCCGUUUXUCX**XC**- invdT |
| 292 388 | 248ex | 628ex | 5U | **XC**XCXXUGGGAAAUGUGAGA UGGGUUXCCXC**XC**-UUUUU- **XC**CXAC-Z-CCGCGCGGAGG CUUGAGGUAGCCGUUUXUCX **XC**-invdT |

TABLE 26-continued

| SEQ ID NO | 5'Apt | 3'Apt | Linker | Sequence |
|---|---|---|---|---|
| 293 389 | 248ex | 628ex | 10U | **XC**XCXXUGGGAAAUGUGAGA UGGGUUXCCXC**XC**-UUUUUU UUUU-**XC**CXAC-Z-CCGCGC GGAGGCUUGAGGUAGCCGUU UXUCX**XC**-invdT |

Where A, C and U are 2'OMe, X is 2'Ome G, G is 2'F G, Z is a 1,3-propanediolspacer, S18 is hexaethyleneglycol and -invdT is an inverted dT residue.
Sequences in bold indicate base pairs added to stabilize a terminal stem and a dash (-) is used to flank the linker.

III. Target Molecules

The aptamers and bispecific aptamers disclosed herein are capable of specifically binding one or more target molecules.

In one embodiment, a bispecific aptamer is disclosed having a first binding moiety and a second binding moiety, wherein the first and second binding moieties bind to different target molecules or antigens. In certain embodiments, the target molecules are proteins and more particularly, selected from the group consisting of VEGF, IL8 and Ang-2.

A. Vascular Endothelial Growth Factor (VEGF)

VEGF-A is thought to be the most significant regulator of angiogenesis in the VEGF family. VEGF-A promotes growth of vascular endothelial cells which leads to the formation of capillary-like structures and may be necessary for the survival of newly formed blood vessels. Vascular endothelial cells are thought to be major effectors of VEGF signaling. Retinal pigment epithelial (RPE) cells may also express VEGF receptors and have been shown to proliferate and migrate upon exposure to VEGF. In addition, VEGF is thought to play roles beyond the vascular system. For example, VEGF may play roles in normal physiological functions, including, but not limited to, bone formation, hematopoiesis, wound healing, and development. In various aspects, the bispecific compositions provided herein include aptamers that bind to VEGF-A, thereby inhibiting or reducing angiogenesis, e.g., by inhibiting or preventing growth of vascular endothelial cells, retinal pigment epithelial cells, or both. In certain embodiments, the bispecific compositions provided herein may prevent or reduce binding or association of VEGF-A with a VEGF receptor (e.g., Flt-1, KDR, Nrp-1) expressed on vascular endothelial cells, retinal pigment epithelial cells, or both.

The VEGF family includes VEGF-A, VEGF-B, VEGF-C, VEGF-D, VEGF-E, VEGF-F, and placental growth factor (PlGF). The aptamers within the bispecific aptamers disclosed herein primarily bind to variants and isoforms of VEGF-A. In certain embodiments, such aptamers may also bind to one or more of VEGF-B, VEGF-C, VEGF-D, VEGF-E, VEGF-F, and PlGF. Transcription of VEGF mRNA may be upregulated under hypoxic conditions. Furthermore, various growth factors and cytokines have been shown to upregulate VEGF mRNA expression, including, without limitation, epidermal growth factor (EGF), transforming growth factor-alpha (TGF-α), transforming growth factor-beta (TGF-β), keratinocyte growth factor (KGF), insulin-like growth factor-1 (IGF-1), fibroblast growth factor (FGF), platelet-derived growth factor (PDGF), interleukin 1-alpha (IL-1-α), interleukin-6 (IL-6), and interleukin-8 (IL8). VEGF-A is thought to play a role in various ocular diseases and disorders such as, but not limited to, diabetic retinopathy (DR), retinopathy of prematurity (ROP), retinal vein occlusion (RVO), branch retinal vein occlusion (BRVO), central retinal vein occlusion (CRVO), choroidal neovascularization (CNV), diabetic macular edema (DME), macular edema, neovascular (or wet) age-related macular degeneration (nAMD or wAMD), myopic choroidal neovascularization, polypoidal choroidal vasculopathy (PCV), punctate inner choroidopathy, presumed ocular histoplasmosis syndrome, familial exudative vitreoretinopathy, and retinoblastoma.

In certain embodiments, the bispecific compositions provided herein may be used to treat an ocular disease or disorder involving one or more factors that upregulate VEGF-A expression and/or activity, including, but not limited to, hypoxic conditions; a growth factor such as EGF, TGF-α, TGF-β, KGF, IGF-1, FGF, or PDGF; and a cytokine such as IL-1-α, IL6, and IL8. In certain embodiments, the bispecific compositions provided herein may be used to treat an ocular disease or disorder selected from the group consisting of: diabetic retinopathy (DR), retinopathy of prematurity (ROP), retinal vein occlusion (RVO), branch retinal vein occlusion (BRVO), central retinal vein occlusion (CRVO), choroidal neovascularization (CNV), diabetic macular edema (DME), macular edema, neovascular (or wet) age-related macular degeneration (nAMD or wAMD), myopic choroidal neovascularization, polypoidal choroidal vasculopathy (PCV), punctate inner choroidopathy, presumed ocular histoplasmosis syndrome, familial exudative vitreoretinopathy, radiation retinopathy and retinoblastoma. The gene for human VEGF-A contains eight exons and encodes at least 16 isoforms. The most common isoforms generated by alternative splicing mechanisms are VEGF-$A_{121}$, VEGF-$A_{165}$, VEGF-$A_{189}$, and VEGF-$A_{206}$. Of these, VEGF-$A_{165}$, VEGF-$A_{189}$, and VEGF-$A_{206}$ each contain a C-terminal heparin binding domain (HBD). In contrast, VEGF-$A_{121}$ lacks a heparin-binding domain. Furthermore, plasmin activation may result in proteolytic cleavage of VEGF-$A_{165}$, VEGF-$A_{189}$, and VEGF-$A_{206}$, resulting in the release of the soluble VEGF-$A_{110}$ variant, which also lacks a heparin-binding domain. In various aspects, the bispecific compositions provided herein may be comprised of at least one aptamer or aptamer domain that binds to and inhibits a function associated with one or more VEGF-A isoforms or variants. For example, the aptamers provided herein may bind to and inhibit a function associated with one or more of VEGF-$A_{110}$, VEGF-$A_{121}$, VEGF-$A_{165}$, VEGF-$A_{189}$, and VEGF-$A_{206}$. In certain embodiments, the bispecific compositions provided herein may be comprised of at least one aptamer or aptamer domain that are pan-variant specific aptamers. In certain embodiments, a pan-variant specific aptamer or aptamer domain is disclosed that binds to each of VEGF-$A_{110}$, VEGF-$A_{121}$, VEGF-$A_{165}$, VEGF-$A_{189}$, and VEGF-$A_{206}$. In certain embodiments, the bispecific compositions provided herein may be comprised of at least one aptamer or aptamer domain that binds to a structural feature that is common to each of VEGF-$A_{110}$, VEGF-$A_{121}$, VEGF-$A_{165}$, VEGF-$A_{189}$, and VEGF-$A_{206}$. For example, the aptamers provided herein may bind to the receptor binding face, or a portion thereof, of each of VEGF-$A_{110}$, VEGF-$A_{121}$, VEGF-$A_{165}$, VEGF-$A_{189}$, and VEGF-$A_{206}$. In certain embodiments, the bispecific aptamers provided herein may be comprised of at least one aptamer or aptamer domain that binds to the receptor binding domain, or a portion thereof, of each of VEGF-$A_{110}$, VEGF-$A_{121}$, VEGF-$A_{165}$, VEGF-$A_{189}$, and VEGF-$A_{206}$. certain embodiments. In certain embodiments, the bispecific compositions provided herein may be comprised of at least one aptamer or aptamer domain that binds to a structural feature of VEGF-A other than the heparin binding domain found in VEGF-$A_{165}$, VEGF-$A_{189}$, and VEGF-A206.

VEGF-A is known to interact with the receptor tyrosine kinases VEGFR1 (also known as Flt-1), VEGFR2 (also known as KDR or Flk-1), and Neuropilin-1 (Nrp-1). Nrp-1 is thought to be a co-receptor for KDR. VEGF receptors have been shown to be expressed by endothelial cells, macrophages, hematopoietic cells, and smooth muscle cells. KDR is a class IV receptor tyrosine kinase that binds 2:1 to VEGF-A dimers. Flt-1 is a receptor tyrosine kinase that binds to VEGF-A with a 3-10-fold higher affinity than KDR, and has also been shown to bind to VEGF-B and PlGF. Flt-1 expression may be upregulated by hypoxia, and its affinity for VEGF-A has been proposed as a negative regulator of signaling by KDR by acting as a decoy receptor. An alternative splicing variant of Flt-1 results in a soluble variant of the receptor (sFlt-1) which has been suggested to act as an anti-angiogenic sink for VEGF-A. Association of VEGF-$A_{165}$ with KDR may be enhanced by the interaction of the heparin binding domain with co-receptor Nrp-1, which may enhance downstream signaling of KDR. Nrp-1 also has strong affinity for Flt-1, which may prevent Nrp-1 association with VEGF-$A_{165}$ and may be a secondary regulatory mechanism for VEGF-A induced angiogenesis.

In certain embodiments, bispecific compositions provided herein may be comprised of at least one aptamer or aptamer domain that binds to one or more isoforms or variants of VEGF-A, and may prevent or reduce binding or association of VEGF-A with a VEGF receptor. For example, bispecific compositions provided herein may prevent or reduce binding of one or more isoforms or variants of VEGF-A with Flt-1, KDR, Nrp-1, or any combination thereof. In certain embodiments, bispecific aptamers provided herein may be comprised of at least one aptamer or aptamer domain that may prevent or reduce binding of one or more of VEGF-$A_{110}$, VEGF-$A_{121}$, VEGF-$A_{165}$, VEGF-$A_{189}$, and VEGF-$A_{206}$ to one or more of Flt-1, KDR, and Nrp-1. In a particular embodiment, bispecific compositions provided herein may be comprised of at least one aptamer or aptamer domain that prevents or reduces binding of one or more isoforms or variants of VEGF-A to KDR. In certain embodiments, the bispecific composition may be comprised of at least one aptamer or aptamer domain that are pan-variant specific aptamers that bind to each of VEGF-$A_{110}$, VEGF-$A_{121}$, VEGF-$A_{165}$, VEGF-$A_{189}$, and VEGF-$A_{206}$, and reduce or prevent binding or association thereof with one or more of Flt-1, KDR, and Nrp-1.

In one embodiment, an amino acid sequence of human VEGF-$A_{206}$ may comprise the following sequence:

```
(SEQ ID NO: 294)
APMAEGGGQNHHEVVKFMDVYQRSYCHPIETLVDIFQEYPDEIEYIFK
PSCVPLMRCGGCCNDEGLECVPTEESNITMQIMRIKPHQGQHIGEMSF
LQHNKCECRPKKDRARQEKKSVRGKGKGQKRKRKKSRYKSWSVYVGAR
CCLMPWSLPGPHPCGPCSERRKHLFVQDPQTCKCSCKNTDSRCKARQL
ELNERTCRCDKPRR.
```

In one embodiment, an amino acid sequence of human VEGF-$A_{189}$ may comprise the following sequence:

```
(SEQ ID NO: 295)
APMAEGGGQNHHEVVKFMDVYQRSYCHPIETLVDIFQEYPDEIEYIFK
PSCVPLMRCGGCCNDEGLECVPTEESNITMQIMRIKPHQGQHIGEMSF
LQHNKCECRPKKDRARQEKKSVRGKGKGQKRKRKKSRYKSWSVPCGPC
SERRKHLFVQDPQTCKCSCKNTDSRCKARQLELNERTCRCDKPRR
```

In one embodiment, an amino acid sequence of human VEGF-A165 may comprise the following

```
(SEQ ID NO: 296)
APMAEGGGQNHHEVVKFMDVYQRSYCHPIETLVDIFQEYPDEIEYIFK
PSCVPLMRCGGCCNDEGLECVPTEESNITMQIMRIKPHQGQHIGEMSF
LQHNKCECRPKKDRARQENPCGPCSERRKHLFVQDPQTCKCSCKNTDS
RCKARQLELNERTCRCDKPRR.
```

In one embodiment, an amino acid sequence of human VEGF-$A_{121}$ may comprise the following

```
(SEQ ID NO: 297)
APMAEGGGQNHHEVVKFMDVYQRSYCHPIETLVDIFQEYPDEIEYIFK
PSCVPLMRCGGCCNDEGLECVPTEESNITMQIMRIKPHQGQHIGEMSF
LQHNKCECRPKKDRARQEKCDKPRR
```

In one embodiment, an amino acid sequence of human VEGF-$A_{110}$ may comprise the following sequence:

```
(SEQ ID NO: 298)
APMAEGGGQNHHEVVKFMDVYQRSYCHPIETLVDIFQEYPDEIEYIFK
PSCVPLMRCGGCCNDEGLECVPTEESNITMQIMRIKPHQGQHIGEMSF
LQHNKCECRPKKDR.
```

Where the aptamer, bispecific aptamer or composition disclosed herein inhibits the function of VEGF, the inhibition may be complete or partial. In certain embodiments, the inhibition is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85% at least 90%, at least 95% or at least 100%.

B. Interleukin-8 (IL8)

Interleukin-8 (IL8; also known as chemokine (C—X—C motif) ligand 8 (CXCL8)), is a chemokine that may be involved in acute and chronic inflammation as well as various human malignancies. IL8 may function by being secreted into the extracellular space and by binding to membrane-bound receptors; as such, the compositions and methods of the disclosure may prevent or reduce binding of IL8 to such membrane-bound receptors. IL8 may be secreted by a number of different cell types, including, but not limited to, monocytes, macrophages, neutrophils, epithelial cells, endothelial cells, tumors cells, melanocytes, and hepatocytes. In the eye, IL8 may be secreted by, for example, retinal pigment epithelial cells, Müller cells, corneal epithelial cells, corneal fibroblasts, conjunctival epithelial cells, and uveal melanocytes. IL8 is upregulated in response tissue damage and a number of other stimuli including hypoxia and oxidative stress, advanced glycation end products, high glucose and complement. IL8 and its receptors may also be upregulated in a surgically induced model of proliferative vitreoretinopathy (PVR). Accordingly, the bispecific aptamer compositions comprised of at least one aptamer or aptamer domain of the disclosure may bind to IL8 after it has been secreted by various cell types.

IL8 is a member of the CXC family of chemokines and may be closely related to GRO-α (also known as CXCL1) and GRO-β (also known as CXCL2). In certain embodiments, the bispecific aptamers are comprised of at least one aptamer or aptamer domain that selectively binds to IL8. In certain embodiments, the aptamers may have little to no binding affinity for GRO-α, GRO-β, or both. In other cases, such anti-IL8 aptamers may also bind to GRO-α, GRO-β, or both. IL8 may signal through both the C—X—C motif chemokine receptor 1 (CXCR1) and the C—X—C motif chemokine receptor 2 (CXCR2); as such, the compositions and methods disclosed herein may prevent or reduce the ability of IL8 to signal through CXCR1, CXCR2, or both. There are thought to be two major isoforms of IL8: $IL8_{72}$ and $IL8_{77}$. $IL8_{77}$ may have a decreased affinity for receptor binding. In certain embodiments, the compositions of bispecific aptamers comprised of at least one aptamer or aptamer domain of the disclosure may include anti-IL8 aptamers that bind to an isoform of IL8. For example, the compositions may include anti-IL8 aptamers that bind to $IL8_{72}$. Additionally, or alternatively, the compositions may include anti-IL8 aptamers that bind to $IL8_{77}$. Additionally, or alternatively, the compositions may include anti-IL8 aptamers that bind to both $IL8_{72}$ and $IL8_{77}$. In addition, IL8 may exist as both a monomer and dimer, both of which may bind to CXCR1, CXCR2, or both. In certain embodiments, the bispecific compositions may include anti-IL8 aptamers that bind to a monomer of IL8. In certain embodiments, the bispecific compositions may include anti-IL8 aptamers that bind to a dimer of IL8.

CXCR1 and CXCR2 are seven-transmembrane-domain containing G-coupled protein receptors (GPCRs) which may signal through intracellular G-proteins. G protein subunits may be released into the cells leading to an increase in intracellular cAMP or phospholipase that may activate MAPK signaling. IL8 binding may cause an increase in 3,4,5-inosital triphosphate which may lead to a rapid increase in free calcium and subsequently to neutrophil degranulation. Neutrophil degranulation may be an important step in the infiltration process that may allow for bacterial clearance. Glycosaminoglycans (GAGs), in particular heparin, may bind to the C-terminus of IL8; such binding is thought to increase the activity of IL8 by allowing for binding to the surface of neutrophils. In certain embodiments, the anti-IL8 compositions of the disclosure may prevent or reduce binding of IL8 to GAGs (e.g., heparin). In certain embodiments, the anti-IL8 compositions may prevent or reduce binding of IL8 to the surface of neutrophils. In addition to the role of IL8 in neutrophil migration, IL8 may affect neovascularization and angiogenesis, thus, anti-IL8 compositions of the disclosure may affect neovascularization, angiogenesis, or both. In this regard, in addition to its interactions with CXCR1 and CXCR2, IL8 has also been reported to interact with the VEGF receptor, VEGFR2, leading to receptor phosphorylation, pathway activation. In certain embodiments, the compositions described herein may affect a signaling pathway associated with IL8 signaling through CXCR1, CXCR2 or VEGFR2. In certain embodiments, the compositions described herein may affect a signaling pathway associated with IL8 signaling through CXCR1, CXCR2 or both. In certain embodiments, the compositions described herein may affect a signaling pathway associated with IL8 signaling through CXCR1, VEGFR2 or both. In certain embodiments, the bispecific compositions described herein may affect a signaling pathway associated with IL8 signaling through CXCR2, VEGFR2 or both. For example, bispecific aptamers of the disclosure may be comprised of at least one aptamer or aptamer domain that may prevent or reduce IL8-induced G protein signaling; without wishing to be bound by theory, such aptamers may prevent an increase in intracellular cAMP or phospholipase, thereby preventing or reducing IL8-induced MAPK signaling. In some examples, the bispecific compositions of the disclosure may prevent or reduce IL8-induced increases in 3,4,5-inositol triphosphate and increases in intracellular free calcium. In certain embodiments, the bispecific compositions of the disclosure may prevent or reduce IL8-induced neutrophil degranulation.

In one embodiment, an amino acid sequence of human $IL8_{78}$ comprises the following sequence:

```
                                          (SEQ ID NO: 299)
AVLPRSAKELRCQCIKTYSKPFHPKFIKELRVIESGPHCANTEIIVKL

SDGRELCLDPKENWVQRVVEKFLKRAENS.
```

In one embodiment, an amino acid sequence of human $IL8_{72}$ may comprise the following sequence:

```
                                          (SEQ ID NO: 300)
SAKELRCQCIKTYSKPFHPKFIKELRVIESGPHCANTEIIVKLSDGRE

LCLDPKENWVQRVVEKFLKRAENS
```

Where the aptamer, bispecific aptamer or composition disclosed herein inhibits the function of IL8 the inhibition may be complete or partial. In certain embodiments, the inhibition is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 100%.

C. Angiopoietins (Ang2)

In addition to the VEGF family, the angiopoietins are thought to be involved in vascular development and angiogenesis. In particular angiopoietin 2, (Ang2) may be important for the development and maintenance of the three mammalian vascular systems; as such, the compositions and methods provided herein may impact the development and maintenance of the vasculature. In preferred embodiments, the methods and compositions provided herein target angiogenesis, and generally may have anti-angiogenic properties.

Ang2 is one of four members of the angiopoietin family of secreted glycoproteins. Additional members of this family include angiopoietin-1 (Ang1), angiopoietin-3 (Ang3) and angiopoietin-4 (Ang4). Ang1 is likely an agonist of the receptor tyrosine kinase (RTK) with Ig and epidermal growth factor homology domains receptor, Tie2. Ang2 is a vertebrate receptor tyrosine kinase antagonist that may also act as a Tie 2 agonist under certain context-specific conditions. Ang2 likely inhibits Ang1-mediated Tie2 phosphorylation by competing for the same receptor-binding site on Tie2.

Sequence homology between Human Ang1 and Ang2 is roughly 64%. Structurally, the angiopoietins are very similar, sharing a notable N-terminal signal peptide (Met1-Thr15 for Ang1 and Met1-Ala18 for Ang2) and super-clustering coiled-coil motif (Phe78-Leu261 for Ang1 and Asp75-Gln248 for Ang2), and a C-terminal fibrinogen-like binding domain, including the receptor binding domain of Ang2 (Arg277-Phe498 for Ang1; Lys275-Phe496 for Ang2). The anti-Ang2 compositions provided herein may be designed to bind specifically to Ang2, and may generally demonstrate little to no binding of Ang1, Ang3, or Ang4.

Disclosed herein are bispecific aptamers comprised of at least one aptamer or aptamer domain that binds to and antagonize a function associated with Ang2. Generally, the aptamers described herein may be designed to bind to a specific region of Ang2, and the mechanism of inhibition of Ang2 function may vary according to where the aptamer binds.

In one embodiment, the bispecific composition is comprised of at least one aptamer or aptamer domain that binds to the receptor binding domain or fibrinogen-like binding domain of Ang2. The C-terminal domain (including the fibrinogen-like binding domain) of Ang2 may be responsible for binding the immunoglobulin (Ig)-like domain of Tie2. Accordingly, bispecific compositions comprised of at least one aptamer or aptamer domain that targets the receptor binding domain or fibrinogen-like binding domain of Ang2 may prevent or reduce binding of Ang2 to Tie2.

In one embodiment, the bispecific composition is comprised of at least one aptamer or aptamer domain that bind to the coiled-coil motif of Ang2. Without wishing to be bound by theory, the coiled-coil motif may be important for mediating the homo- and heterodimerization of the angiopoietins. In certain embodiments, homo- and heterodimerization of the angiopoietins may be important for influencing the activity of Tie2 and the downstream signaling processes that it controls. In certain embodiments, Ang2 may be found as tetramers, hexamers and higher-order oligomers in solution. Thus, in certain embodiments, the bispecific compositions may bind to the coiled-coil motif of Ang2. In certain embodiments, such bispecific compositions may prevent homo- and/or heterodimerization of Ang2. In certain embodiments, such bispecific compositions may prevent or reduce formation of tetramers hexamers, or higher-order oligomers of Ang2.

In certain embodiments, a bispecific composition is disclosed comprised of at least one aptamer or aptamer domain that bind to regions of Ang2 that are involved in binding to specific cell-surface co-receptors. Endothelial cells may contain unique Tie2 binding co-receptors such as the Tie2 homolog, Tie1, or integrins, which may provide a means to discriminate the angiopoietins from each other. Although Tie2 may be the primary receptor of the angiopoietins, integrins such as the αvβ3, αvβ5 and α5β1 integrins may also be capable of binding to Ang2, albeit with low affinity, and may play a role in regulating the activities of these proteins in both a Tie2-dependent and Tie2-independent manner. Thus, although the dominant cellular responses to Ang2 may result from direct interactions with Tie2, they may also involve the interactions of co-receptors. Alternatively, cellular responses to Ang2 may occur through direct interactions with the integrins themselves. Hence, in certain embodiments, the bispecific compositions provided herein may bind to regions of Ang2 that prevent binding of Ang2 with Tie1, αvβ3 integrin, αvβ5 integrin, and/or α5β1 integrin.

In one embodiment, an amino acid sequence of human Ang2 comprises the following sequence:

```
                                      (SEQ ID NO: 301)
YNNFRKSMDSIGKKQYQVQHGSCSYTFLLPEMDNCRSSSSPYVSNAVQ

RDAPLEYDDSVQRLQVLENIMENNTQWLMKLENYIQDNMKKEMVEIQQ
```

-continued

```
NAVQNQTAVMIEIGTNLLNQTAEQTRKLTDVEAQVLNQTTRLELQLLE

HSLSTNKLEKQILDQTSEINKLQDKNSFLEKKVLAMEDKHIIQLQSIK

EEKDQLQVLVSKQNSIIEELEKKIVTATVNNSVLQKQQHDLMETVNNL

LTMMSTSNSAKDPTVAKEEQISFRDCAEVFKSGHTTNGIYTLTFPNST

EEIKAYCDMEAGGGGWTIIQRREDGSVDFQRTWKEYKVGFGNPSGEYW

LGNEFVSQLTNQQRYVLKIHLKDWEGNEAYSLYEHFYLSSEELNYRIH

LKGLTGTAGKISSISQPGNDFSTKDGDNDKCICKCSQMLTGGWWFDAC

GPSNLNGMYYPQRQNTNKFNGIKWYYWKGSGYSLKATTMMIRPADF.
```

Where the aptamer, bispecific aptamer or composition disclosed herein inhibits the function of Ang2 the inhibition may be complete or partial. In certain embodiments, the inhibition is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 100%.

IV. Methods of Use

Disclosed herein are methods for the treatment of ocular diseases or disorders utilizing the aptamers, bispecific aptamers or compositions disclosed herein.

Generally, the methods disclosed herein involve administration of the bispecific aptamer to a subject in need thereof and in particular, methods of treatment involve administration of the bispecific aptamer or a pharmaceutical composition comprising the same to a subject in need thereof.

The subject may have been previously diagnosed with an ocular disorder (e.g., a retinal disease or disorder) or may be at risk for developing an ocular disease or disorder (e.g., a retinal disease or disorder) due to one or more factors, for example, age, obesity, diabetes, smoking, eye trauma or family history.

In certain embodiments, the methods include the use of a bispecific aptamer comprised of an anti-VEGF aptamer domain linked to an anti-IL8 aptamer domain for, e.g., the treatment of ocular diseases or disorders. In certain embodiments, the methods include the use of a bispecific aptamer comprised of a pan specific anti-VEGF aptamer domain linked to an anti-IL8 aptamer domain. In certain embodiments, the ocular disease or disorder may be age-related macular degeneration. In a particular embodiment, macular degeneration may be the wet form of age-related macular degeneration (wAMD). In a particular embodiment, macular degeneration may be the dry form of age-related macular degeneration (dAMD). In certain embodiments, the ocular disease or disorder may be proliferative diabetic retinopathy. In certain embodiments, the ocular disease or disorder may be diabetic retinopathy. In certain embodiments, the ocular disease or disorder may be diabetic macular edema. In certain embodiments, the ocular disease or disorder may be nonarteritic anterior ischemic optic neuropathy. In certain embodiments, the ocular disease or disorder may be uveitis. Uveitis can be, for example, infectious uveitis or non-infectious uveitis. Uveitis can be, for example, Iritis (anterior uveitis); Cyclitis (intermediate uveitis); Choroiditis and retinitis (posterior uveitis); and/or Diffuse uveitis (panuveitis). In certain embodiments, the ocular disease or disorder may be Behçet's disease. In certain embodiments, the ocular disease or disorder may be Coats' disease. In certain embodiments, the ocular disease or disorder may be retinopathy of prematurity. In certain embodiment, the ocular disease or disorder may be dry eye. In certain embodiments, the ocular disease or disorder may be allergic conjunctivitis. In certain embodiments, the ocular disease or disorder may be pterygium. In certain embodiments, the ocular disease or disorder may be branch retinal vein occlusion. In certain embodiments, the ocular disease or disorder may be central retinal vein occlusion. In certain embodiments, the ocular disease or disorder may be adenovirus keratitis. In certain embodiments, the ocular disease or disorder may be corneal ulcers. In certain embodiments, the ocular disease or disorder may be vernal keratoconjunctivitis. In certain embodiments, the ocular disease or disorder may be Stevens-Johnson syndrome. In certain embodiments, the ocular disease or disorder may be corneal herpetic keratitis. In certain embodiments, the ocular disease or disorder may be rhegmatogenous retinal detachment. In certain embodiments, the ocular disease or disorder may be pseudo-exfoliation syndrome. In certain embodiments, the ocular disease or disorder may be proliferative vitreoretinopathy. In certain embodiments, the ocular disease or disorder may be infectious conjunctivitis. In certain embodiments, the ocular disease or disorder may be geographic atrophy. In certain embodiments, the ocular disease or disorder may be Stargardt disease. In certain embodiments, the ocular disease or disorder may be retinitis pigmentosa. In certain embodiments, the ocular disease or disorder may be Contact Lens-Induced Acute Red Eye (CLARE). In certain embodiments, ocular disease or disorder may be conjunctivochalasis. In certain embodiments, the ocular disease or disorder may be an inherited retinal disease. In certain embodiments, the ocular disease or disorder may be a retinal degenerative disease. In certain embodiments, a subject having an ocular disease or disorder may exhibit elevated levels of VEGF. In certain embodiments, a subject having an ocular disease or disorder may exhibit elevated levels of IL8. In certain embodiments, a subject having an ocular disease or disorder may exhibit elevated levels of VEGF and IL8. In certain embodiments, a subject having an ocular disease or disorder may exhibit elevated bisretinoids such as, for example, N-retinylidene-N-retinylethanolamine (A2E)._In certain embodiments, the methods may include the use of a bispecific aptamer comprised of a pan specific anti-VEGF aptamer domain linked to an anti-IL8 aptamer domain for the treatment of any of the aforementioned diseases that do not respond or show in complete response to anti-VEGF treatment alone (e.g., VEGF non-responders).

In certain embodiment, the methods may involve the inhibition of a function associated with IL8. In certain embodiments, the methods involve preventing or reducing IL8 binding to CXCR1, CXCR2, or both. In certain embodiments, the methods may involve preventing or reducing IL8 binding to CXCR1, CXCR2, VEGFR2 or any combination thereof. In certain embodiments, the methods may involve preventing or reducing downstream signaling associated with CXCR1, CXCR2, or both. In certain embodiments, the methods may involve preventing or reducing downstream signaling associated with CXCR1, CXCR2, VEGFR2 or any combination thereof. In certain embodiments, the methods may involve the inhibition of a function associated with IL8 for the treatment of ocular diseases or disorders. In some aspects of the disclosure, the methods may involve partial or complete inhibition of a function associated with IL8. In certain embodiments, the methods may involve partial or complete inhibition of a function associated with IL8 for the treatment of ocular diseases. Additionally, or alternatively, the methods may involve partial or complete inhibition of a function associated with IL8, in combination with partial or complete inhibition of a function associated with VEGF, for the treatment of an ocular disease or disorder. In certain embodiments, the methods may involve the inhibition of a function associated with IL8 for the treatment of wet age-related macular degeneration. In certain embodiments, the methods may involve the inhibition of a function associated with IL8 for the treatment of dry age-related macular degeneration. In certain embodiments, the methods may involve the inhibition of a function associated with IL8 for the treatment of geographic atrophy. In certain embodiments, the methods may involve the inhibition of a function associated with IL8 for the treatment of proliferative diabetic retinopathy. In certain embodiments, the methods may involve the inhibition of a function associated with IL8 for the treatment of retinal vein occlusion. In certain embodiments, the method may involve the inhibition of a function associated with IL8 for the treatment of central retinal vein occlusion. In certain embodiments, the methods may involve the inhibition of a function associated with IL8 for the treatment of diabetic retinopathy. In certain embodiments, the methods may involve the inhibition of a function associated with IL8 for the treatment of diabetic macular edema. In certain embodiments, the methods may involve the inhibition of a function associated with IL8 for the treatment of nonarteritic anterior ischemic optic neuropathy. In certain embodiments, the methods may involve the inhibition of a function associated with IL8 for the treatment of uveitis. Uveitis can be, for example, infectious uveitis or non-infectious uveitis. Uveitis can be, for example, Iritis (anterior uveitis); Cyclitis (intermediate uveitis); Choroiditis and retinitis (posterior uveitis); and/or Diffuse uveitis (panuveitis). In certain embodiments, the methods may involve the inhibition of a function associated with IL8 for the treatment of Behçet's disease. In certain embodiments, the methods may involve the inhibition of a function associated with IL8 for the treatment of Coats' disease. In certain embodiments, the methods may involve the inhibition of a function associated with IL8 for the treatment of retinopathy of prematurity. In certain embodiments, the methods may involve the inhibition of a function associated with IL8 for the treatment of dry eye. In certain embodiments, the methods and s may involve the inhibition of a function associated with IL8 for the treatment of allergic conjunctivitis. In certain embodiments, the methods may involve the inhibition of a function associated with IL8 for the treatment of pterygium. In certain embodiments, the methods may involve the inhibition of a function associated with IL8 for the treatment of branch retinal vein occlusion. In certain embodiments, the methods may involve the inhibition of a function associated with IL8 for the treatment of central retinal vein occlusion. In certain embodiments, the methods may involve the inhibition of a function associated with IL8 for the treatment of adenovirus keratitis. In certain embodiments, the methods may involve the inhibition of a function associated with IL8 for the treatment of corneal ulcers. In certain embodiments, the methods may involve the inhibition of a function associated with IL8 for the treatment of vernal keratoconjunctivitis. In certain embodiments, the methods may involve the inhibition of a function associated with IL8 for the treatment of Stevens-Johnson syndrome. In certain embodiments, the methods may involve the inhibition of a function associated with IL8 for the treatment of corneal herpetic keratitis. In certain embodiments, the methods may involve the inhibition of a function associated with IL8 for the treatment of rhegmatogenous retinal detachment. In certain embodiments, the methods may involve the inhibition of a function associated with IL8 for the treatment of pseudo-exfoliation syndrome. In certain embodiments, the methods may involve the inhibition of a function associated with IL8 for the treatment of proliferative vitreoretinopathy. In certain embodiments, the methods and compositions the inhibition of a function associated with IL8 for the treatment of infectious conjunctivitis. In certain embodiments, the methods may involve the inhibition of a function associated with IL8 for the treatment of Stargardt disease. In certain embodiments, the methods may involve the inhibition of a function associated with IL8 for the treatment of retinitis pigmentosa. In certain embodiments, the methods may involve the inhibition of a function associated with IL8 for the treatment of Contact Lens-Induced Acute Red Eye (CLARE). In certain embodiments, the methods may involve the inhibition of a function associated with IL8 for the treatment of symptoms associated with conjunctivochalasis. In certain embodiments, the methods may involve the inhibition of a function associated with IL8 for the treatment of an inherited retinal disease. In certain embodiments, the methods and may involve the inhibition of a function associated with IL8 for the treatment of a retinal degenerative disease. In certain embodiments, the methods may involve the inhibition of a function associated with IL8 for the treatment of an ocular disease or disorder exhibiting elevated levels of IL8. In certain embodiments, the methods may involve the inhibition of a function associated with IL8 for the treatment an ocular disease or disorder exhibiting elevated levels of bisretinoids, such as, for example, N-retinylidene-N-retinylethanoloamine (A2E).

In certain embodiments, the methods may involve the inhibition of a function associated with VEGF-A. In certain embodiments, the methods may involve preventing or reducing VEGF-A binding to or interaction with one or more VEGF receptors. For example, the methods may involve preventing or reducing VEGF-A binding to or interaction with Flt-1, KDR, Nrp-1, or any combination thereof. In certain embodiments, the methods and may involve preventing or reducing downstream signaling associated with Flt-1, KDR, Nrp-1, or any combination thereof. In certain embodiments, the methods may involve the inhibition of a function associated with VEGF-A for the treatment of ocular diseases or disorders. In certain embodiments, the methods may involve the inhibition of a function associated with VEGF-A for the treatment of diabetic retinopathy. In certain embodiments, the methods may involve the inhibition of a function associated with VEGF-A for the treatment of retinopathy of prematurity. In certain embodiments, the methods and compositions may involve the inhibition of a function associated with VEGF-A for the treatment of central retinal vein occlusion. In certain embodiments, the methods may involve the inhibition of a function associated with VEGF-A for the treatment of macular edema. In certain embodiments, the methods may involve the inhibition of a function associated with VEGF-A for the treatment of choroidal neovascularization. In certain embodiments, the methods and may involve the inhibition of a function associated with VEGF-A for the treatment of neovascular (or wet) age-related macular degeneration. In certain embodiments, the methods may involve the inhibition of a function associated with VEGF-A for the treatment of myopic choroidal neovascularization. In certain embodiments, the methods and compositions may involve the inhibition of a function associated with VEGF-A for the treatment of punctate inner choroidopathy. In certain embodiments, the methods and compositions may involve the inhibition of a function associated with VEGF-A for the treatment of presumed ocular histoplasmosis syndrome. In certain embodiments, the methods may involve the inhibition of a function associated with VEGF-A for the treatment of familial exudative vitreoretinopathy. In certain embodiments, the methods may involve the inhibition of a function associated with VEGF-A for the treatment of retinoblastoma. In certain embodiments, the methods may involve the inhibition of a function associated with VEGF-A for the treatment of an ocular disease or disorder exhibiting elevated levels of one or more isoforms or variants of VEGF-A.

Additionally or alternatively, the methods may involve the inhibition of a function associated with IL8, in combination with inhibition of a function associated with VEGF, for the treatment of any one of the following: wet age-related macular degeneration, dry age-related macular degeneration, geographic atrophy, proliferative diabetic retinopathy, retinal vein occlusion, central retinal vein occlusion, diabetic retinopathy, diabetic macular edema, central serous chorioretinopathy, X-linked retinitis pigmentosa, X-linked retinoschisis, nonarteritic anterior ischemic optic neuropathy, uveitis (including infectious uveitis, non-infectious uveitis, iritis (anterior uveitis), cyclitis (intermediate uveitis), choroiditis and retinitis (posterior uveitis), diffuse uveitis (panuveitis)), scleritis, optic neuritis, optic neuritis secondary to multiple sclerosis, macular pucker, Behçet's disease, Coats' disease, retinopathy of prematurity, open angle glaucoma, neovascular glaucoma, dry eye, allergic conjunctivitis, pterygium, branch retinal vein occlusion, adenovirus keratitis, corneal ulcers, vernal keratoconjunctivitis, blepharitis, epithelial basement membrane dystrophy, Stevens-Johnson syndrome, achromatophasia, corneal herpetic keratitis, keratoconus, rhegmatogenous retinal detachment, pseudo-exfoliation syndrome, proliferative vitreoretinopathy, infectious conjunctivitis, Stargardt disease, retinitis pigmentosa, Contact Lens-Induced Acute Red Eye (CLARE), conjunctivochalasis, inherited retinal disease, a retinal degenerative disease, an ocular disease or disorder exhibiting elevated levels of IL8, and an ocular disease or disorder exhibiting elevated levels of bisretinoids, such as, for example, N-retinylidene-N-retinylethanoloamine (A2E).

Additionally, or alternatively, the methods and compositions may involve the inhibition of a function associated with the combination of any two targets selected from the group consisting of VEGF-A, IL8, Ang2, C5, PDGF, FGF, and Factor D.

When the methods disclosed herein result in an inhibition of function or a reduction of symptoms or the like, the inhibition or reduction may be partial or complete. In certain embodiments, the inhibition or reduction is at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or at least about 100%.

In certain embodiments, the result of treatment is measured using visual functional outcomes measures, structural outcomes measures or patient self-reported outcome measures. In one embodiment, the result of treatment is measured (compared to baseline) for visual acuity, scotopic and mesopic microperimetry sensitivity, low luminance visual acuity, vanishing optotypes visual acuity, low luminance deficit or the like.

In a particular embodiment, treatment results in an increase in overall best corrected visual acuity (BCVA) as measured on the Early Treatment Diabetic Retinopathy Study (ETDRS) chart by at least 3 letters, at least 4 letters, at least 5 letters, at least 6 letters, at least 7 letters, at least 8 letters, at least 9 letters, at least 10 letters, at least 11 letters, at least 12 letters, at least 13 letters, at least 14 letters, at least 15 letters, at least 16 letters, at least 17 letters, at least 18 letters, at least 19 letters, at least 20 letters, or more than 20 letters as compared to an untreated control subject over a defined period of time, selected from at least one of 2 weeks, one month, 2 months, 3 months, 6 months, one year, 2 years, or 5 years.

In one embodiment, treatment results in a percentage of patients gaining >15 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients gaining >10 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients gaining >5 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients avoiding the loss of ≥15 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients avoiding the loss of ≥10 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years. In one embodiment, treatment results in a percentage of patients avoiding the loss of ≥5 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In one embodiment, treatment results in a percentage of patients avoiding the loss of ≥0 letters in BCVA from baseline of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, treatment results in a reduction of retinal fluid as measured by fluorescein angiography (FA) and optical coherence tomography (OCT) of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, treatment results in a reduction of retinal thickness as measured by fluorescein angiography (FA) and optical coherence tomography (OCT) of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, treatment results in a reduction of the total area of choroidal neovascular (CNV) lesions as measured by fluorescein angiography (FA) and optical coherence tomography (OCT) of at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more as compared to an untreated control subject over a defined period of time, selected from at least one of 2 weeks, one month, 2 months, 3 months, 6 months, one year, 2 years, or 5 years.

In a particular embodiment, administration of an effective amount of the bispecific aptamer or pharmaceutical composition comprising the same refers to the amount of the bispecific aptamer or pharmaceutical composition disclosed herein that that decreases the loss of overall visual acuity, the loss of visual field, by at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or more as compared to an untreated control subject over a defined period of time, selected from at least one of 2 weeks, one month, 2 months, 3 months, 6 months, one year, 2 years, or 5 years.

Also provided are kits. Such kits can include the bispecific aptamer described herein and, in certain embodiments, instructions for administration. Such kits can facilitate performance of the methods described herein. When supplied as a kit, the different components of the compositions disclosed herein can be packaged in separate containers and admixed immediately before use. In one embodiment, the bispecific composition is formulated as a pre-filled syringe.

V. Aptamers

In certain embodiments, the methods and compositions described herein use bispecific aptamers for the treatment of an ocular disease. In certain embodiments, the methods and compositions described herein may use one or more anti-VEGF aptamers, one of more anti-IL8 aptamers or one or more anti-Ang2 aptamers. In certain embodiments, the methods and compositions described herein utilize one or more aptamers for inhibiting an activity associated with VEGF, IL8, or Ang2.

Aptamers and bispecific aptamers described herein may include any number of modifications that can affect the function or affinity of the aptamer. For example, aptamers may be unmodified or they may contain modified nucleotides to improve stability, nuclease resistance or delivery characteristics. Examples of such modifications may include chemical substitutions at the sugar and/or phosphate and/or base positions, for example, at the 2' position of ribose, the 5 position of pyrimidines, the 8 position of purines. Various 2'-modified pyrimidines and purines are well-known, including modifications of 2'-amino (2'-$NH_2$), 2'-fluoro (2'-F), and/or 2'-O-methyl (2'-OMe) substituents. In certain embodiments, aptamers described herein comprise a 2'-OMe and/or a 2'F modification to increase in vivo stability. In certain embodiments, the aptamers described herein contain modified nucleotides to improve the affinity and specificity of the aptamers for a target. Examples of modified nucleotides include those modified with guanidine, indole, amine, phenol, hydroxymethyl, or boronic acid. In other cases, pyrimidine nucleotide triphosphate analogs or CE-phosphoramidites may be modified at the 5 position to generate, for example, 5-benzylaminocarbonyl-2'-deoxyuridine (BndU); 5-[N-(phenyl-3-propyl)carboxamide]-2'-deoxyuridine (PPdU); 5-(N-thiophenylmethylcarboxyamide)-2'-deoxyuridine (ThdU); 5-(N-4-fluorobenzylcarboxyamide)-2'-deoxyuridine (FBndU); 5-(N-(1-naphthylmethyl) carboxamide)-2'-deoxyuridine (NapdU); 5-(N-2-naphthylmethylcarboxyamide)-2'-deoxyuridine (2NapdU); 5-(N-1-naphthylethylcarboxyamide)-2'-deoxyuridine (NEdU); 5-(N-2-naphthylethylcarboxyamide)-2'-deoxyuridine (2NEdU); 5-(N-tryptaminocarboxyamide)-2'-deoxyuridine (TrpdU); 5-isobutylaminocarbonyl-2'-deoxyuridine (IbdU); 5-(N-tyrosylcarboxyamide)-2'-deoxyuridine (TyrdU); 5-(N-isobutylaminocarbonyl-2'-deoxyuridine (iBudU); 5-(N-benzylcarboxyamide)-2'-O-methyluridine, 5-(N-benzylcarboxyamide)-2'-fluorouridine, 5-(N-phenethylcarboxyamide)-2'-deoxyuridine (PEdU), 5-(N-3,4-methylenedioxybenzylcarboxyamide)-2'-deoxyuridine (MBndU), 5-(N-imidizolylethylcarboxyamide)-2'-deoxyuridine (ImdU), 5-(N-isobutylcarboxyamide)-2'-O-methyluridine, 5-(N-isobutylcarboxyamide)-2'-fluorouridine, 5-(N—R-threoninylcarboxyamide)-2'-deoxyuridine (ThrdU), 5-(N-tryptaminocarboxyamide)-2'-O-methyluridine, 5-(N-tryptaminocarboxyamide)-2'-fluorouridine, 5-(N-[1-(3-trimethylamonium)propyl]carboxyamide)-2'-deoxyuridine chloride, 5-(N-naphthylmethylcarboxyamide)-2'-O-methyluridine, 5-(N-naphthylmethylcarboxyamide)-2'-fluorouridine, 5-(N-[1-(2,3-dihydroxypropyl)]carboxyamide)-2'-deoxyuridine), 5-(N-2-naphthylmethylcarboxyamide)-2'-O-methyluridine, 5-(N-2-naphthylmethylcarboxyamide)-2'-fluorouridine, 5-(N-1-naphthylethylcarboxyamide)-2'-O-methyluridine, 5-(N-1-naphthylethylcarboxyamide)-2'-fluorouridine, 5-(N-2-naphthylethylcarboxyamide)-2'-O-methyluridine, 5-(N-2-naphthylethylcarboxyamide)-2'-fluorouridine, 5-(N-3-benzofuranylethylcarboxyamide)-2'-deoxyuridine (BFdU), 5-(N-3-benzofuranylethylcarboxyamide)-2'-O-methyluridine, 5-(N-3-benzofuranylethylcarboxyamide)-2'-fluorouridine, 5-(N-3-benzothiophenylethylcarboxyamide)-2'-deoxyuridine (BTdU), 5-(N-3-benzothiophenylethylcarboxyamide)-2'-O-methyluridine, 5-(N-3-benzothiophenylethylcarboxyamide)-2'-fluorouridine; 5-[N-(1-morpholino-2-ethyl)carboxamide]-2'-deoxyuridine (MOEdu); R-tetrahydrofuranylmethyl-2'-deoxyuridine (RTMdU); 3-methoxybenzyl-2'-deoxyuridine (3MBndU); 4-methoxybenzyl-2'-deoxyuridine (4MBndU); 3,4-dimethoxybenzyl-2'-deoxyuridine (3,4DMBndU); S-tetrahydrofuranylmethyl-2'-deoxyuridine (STMdU); 3,4-methylenedioxyphenyl-2-ethyl-2'-deoxyuridine (MPEdU); 4-pyridinylmethyl-2'-deoxyuridine (PyrdU); or 1-benzimidazol-2-ethyl-2'-deoxyuridine (BidU); 5-(amino-1-propenyl)-2'-deoxyuridine; 5-(indole-3-acetamido-1-propenyl)-2'-deoxyuridine; or 5-(4-pivaloylbenzamido-1-propenyl)-2'-deoxyuridine.

Modifications of the aptamers and bispecific aptamers contemplated in this disclosure include, without limitation, those which provide other chemical groups that incorporate additional charge, polarizability, hydrophobicity, hydrogen bonding, electrostatic interaction, and functionality to the nucleic acid aptamer bases or to the nucleic acid aptamer as a whole. Modifications to generate oligonucleotide populations that are resistant to nucleases can also include one or more substitute internucleotide linkages, altered sugars, altered bases, or combinations thereof. Such modifications include, but are not limited to, 2'-position sugar modifications, 5-position pyrimidine modifications, 8-position purine modifications, modifications at exocyclic amines, substitution of 4-thiouridine, substitution of 5-bromo or 5-iodo-uracil; backbone modifications, phosphorothioate, phosphorodithioate, or alkyl phosphate modifications, methylations, and unusual base-pairing combinations such as the isobases isocytidine and isoguanosine. Modifications can also include 3' and 5' modifications such as capping, e.g., addition of a 3'-3'-dT cap to increase exonuclease resistance.

Aptamers and bispecific aptamers of the disclosure may generally comprise nucleotides having ribose in the β-D-ribofuranose configuration. In certain embodiments, 100% of the nucleotides present in the aptamer have ribose in the 3-D-ribofuranose configuration. In certain embodiments, at least 50% of the nucleotides present in the aptamer have ribose in the β-D-ribofuranose configuration. In certain embodiments, at least 10%, at least 20%, at least 30%, at least 40%, at least 50%, at least 60%, at least 70%, at least 80%, at least 90%, or 100% of the nucleotides present in the aptamer have ribose in the β-D-ribofuranose configuration.

The length of the aptamer or aptamer domain within a bispecific aptamer can be variable. In certain embodiments, the length is less than 100 nucleotides. In certain embodiments, the length is greater than 10 nucleotides. In certain embodiments, the length is between 10 and 90 nucleotides. The aptamer comprising an aptamer domain of a bispecific aptamer can be, without limitation, about 10, about 15, about 20, about 25, about 30, about 35, about 40, about 45, about 50, about 55, about 60, about 65, about 70, about 75, about 80, about 85, or about 90 nucleotides in length.

In one embodiment, the bispecific aptamer is 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides in length.

In certain embodiments, the nucleic acid sequence of the VEGF-A aptamer domain of the bispecific composition, may have a degree of primary sequence identity with one of SEQ ID NOS: 1-46, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In certain embodiments, the nucleic acid sequence of the IL8 aptamer domain of the bispecific composition, may have a degree of primary sequence identity with one of SEQ ID NOS: 47-48, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In certain embodiments, the nucleic acid sequence of the Ang2 aptamer domain of the bispecific composition, may have a degree of primary sequence identity with one of SEQ ID NOS: 49-50, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In certain embodiments, the nucleic acid sequence of the C5 aptamer domain of the bispecific composition, may have a degree of primary sequence identity with SEQ ID NO: 51, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In certain embodiments, the nucleic acid sequence of the PDGF aptamer domain of the bispecific composition, may have a degree of primary sequence identity with SEQ ID NO: 52, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In certain embodiments, the nucleic acid sequence of the FGF2 aptamer domain of the bispecific composition, may have a degree of primary sequence identity with SEQ ID NO: 53, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In certain embodiments, the nucleic acid sequence of the Factor D aptamer domain of the bispecific composition, may have a degree of primary sequence identity with SEQ ID NO: 54, that is at least one of 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%. In some instances, a polyethylene glycol (PEG) polymer chain is covalently bound to the aptamer or bispecific aptamer, referred to herein as PEGylation. Without wishing to be bound by theory, PEGylation may increase the half-life and stability of the aptamer in physiological conditions. In certain embodiments, the PEG polymer is covalently bound to the 5' end of the aptamer or bispecific aptamer. In certain embodiments, the PEG polymer is covalently bound to the 3' end of the aptamer or bispecific aptamer. In certain embodiments, the PEG polymer is covalently bound to both the 5' end and the 3' end of the aptamer or bispecific aptamer. In certain embodiments, the PEG polymer is covalently bound to a specific site on a nucleobase within the aptamer, including the 5-position of a pyrimidine or 8-position of a purine. In certain embodiments, the PEG polymer is covalently bound to a basic site within the aptamer or bispecific aptamer. In certain embodiments, the PEG polymer is covalently bound to the first aptamer domain within the bispecific aptamer. In certain embodiments, the PEG polymer is covalently bound to the second aptamer domain within the bispecific aptamer. In certain embodiments, the PEG polymer is covalently bound to both aptamer domains within the bispecific aptamer.

Polyethylene Glycol

In certain embodiments, an aptamer or bispecific aptamer described herein may be conjugated to a PEG having the general formula, $H—(O—CH_2—CH_2)_n—OH$. In certain embodiments, an aptamer or bispecific aptamer described herein may be conjugated to a methoxy-PEG (mPEG) of the general formula, $CH_3O—(CH_2—CH_2—O)_n—H$. In certain embodiments, the aptamer or bispecific aptamer is conjugated to a linear chain PEG or mPEG. The linear chain PEG or mPEG may have an average molecular weight of up to about 30 kD. Multiple linear chain PEGs or mPEGs can be linked to a common reactive group to form multi-arm or branched PEGs or mPEGs. For example, more than one PEG or mPEG can be linked together through an amino acid linker (e.g., lysine) or another linker, such as glycerine. In certain embodiments, the aptamer or bispecific aptamer is conjugated to a branched PEG or branched mPEG. Branched PEGs or mPEGs may be referred to by their total mass (e.g., two linked 20 kD mPEGs have a total molecular weight of 40 kD). Branched PEGs or mPEGs may have more than two arms. Multi-arm branched PEGs or mPEGs may be referred to by their total mass (e.g., four linked 10 kD mPEGs have a total molecular weight of 40 kD). In certain embodiments, an aptamer or bispecific aptamer of the present disclosure is conjugated to a PEG polymer having a total molecular weight from about 5 kD to about 200 kD, for example, about 5 kD, about 10 kD, about 20 kD, about 30 kD, about 40 kD, about 50 kD, about 60 kD, about 70 kD, about 80 kD, about 90 kD, about 100 kD, about 110 kD, about 120 kD, about 130 kD, about 140 kD, about 150 kD, about 160 kD, about 170 kD, about 180 kD, about 190 kD, or about 200 kD. In one non-limiting example, the aptamer or bispecific aptamer is conjugated to a PEG having a total molecular weight of about 40 kD.

In certain embodiments, the reagent that may be used to generate PEGylated aptamers is a branched PEG N-Hydroxysuccinimide (mPEG-NHS) having the general formula:

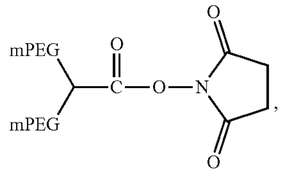, with a 20 kD, 40 kD or 60 kD total molecular weight (e.g., where each mPEG is about 10 kD, 20 kD or about 30 kD). As described above, the branched PEGs can be linked through any appropriate reagent, such as an amino acid (e.g., lysine or glycine residues).

In one non-limiting example, the reagent used to generate PEGylated aptamers is [$N^2$-(monomethoxy 20K polyethylene glycol carbamoyl)-$N^6$-(monomethoxy 20K polyethylene glycol carbamoyl)]-lysine N-hydroxysuccinimide having the formula:

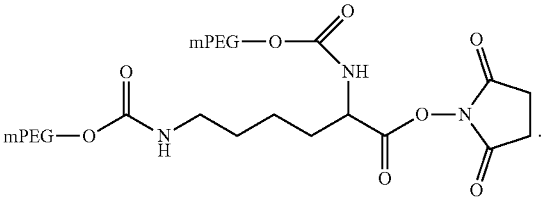

In yet another non-limiting example, the reagent used to generate PEGylated aptamers or bispecific aptamers has the formula:

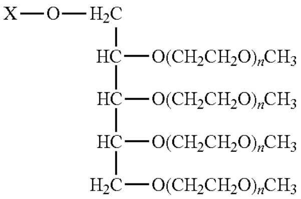

where X is N-hydroxysuccinimide and the PEG arms are of approximately equivalent molecular weight. Such PEG architecture may provide a compound with reduced viscosity compared to a similar aptamer conjugated to a two-armed or single-arm linear PEG.

In some examples, the reagent used to generate PEGylated aptamers has the formula:

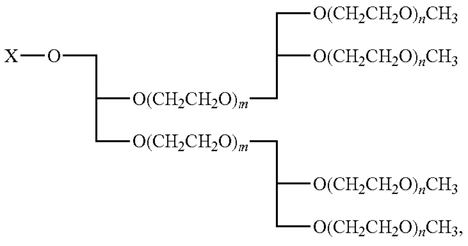

where X is N-hydroxysuccinimide and the PEG arms are of different molecular weights, for example, a 40 kD PEG of this architecture may be composed of 2 arms of 5 kD and 4 arms of 7.5 kD. Such PEG architecture may provide a compound with reduced viscosity compared to a similar aptamer conjugated to a two-armed PEG or a single-arm linear PEG.

In certain embodiments, the reagent that may be used to generate PEGylated aptamers is a non-branched mPEG-Succinimidyl Propionate (mPEG-SPA), having the general formula:

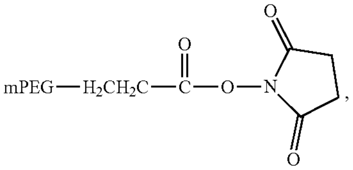

where mPEG is about 20 kD or about 30 kD. In one example, the reactive ester may be —O—CH2-CH2-CO2-NHS.

In some embodiments, the reagent that may be used to generate PEGylated aptamers may include a branched PEG linked through glycerol, such as the SUNBRIGHT® series from NOF Corporation, Japan. Non-limiting examples of these reagents include:

(SUNBRIGHT® GL2-400GS2)

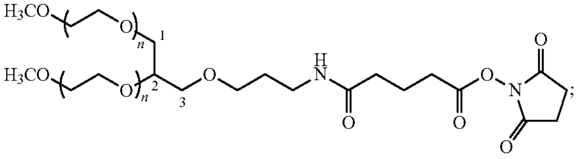

;

(SUNBRIGHT® GL2-400HS)

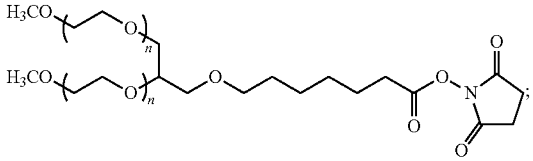

; and (SUNBRIGHT® GL2-400GTS)

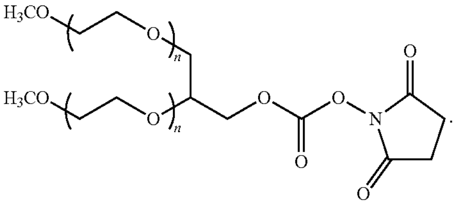

In another embodiment, the reagents may include a non-branched mPEG Succinimidyl alpha-methylbutanoate (mPEG-SMB) having the general formula:

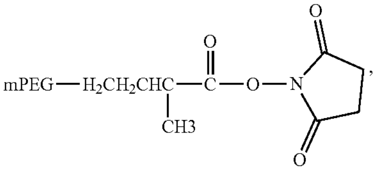

where mPEG is between 10 and 30 kD. In one example, the reactive ester may be —O—$CH_2$—$CH_2$—CH(CH3)-CO2-NHS.

In certain embodiments, the PEG reagents may include nitrophenyl carbonate-linked PEGs, having the general formula:

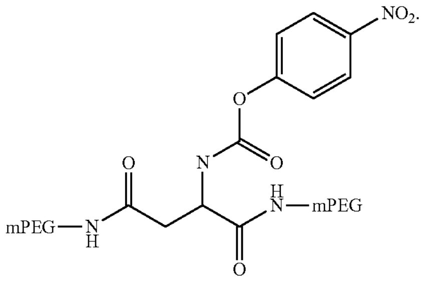

Compounds including nitrophenyl carbonate can be conjugated to primary amine containing linkers.

In certain embodiments, the reagents used to generate PEGylated aptamers may include PEG with thiol-reactive groups that can be used with a thiol-modified linker. One non-limiting example may include reagents having the following general structure:

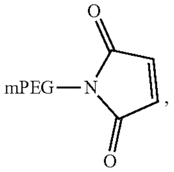

where mPEG is about 10 kD, about 20 kD or about 30 kD.

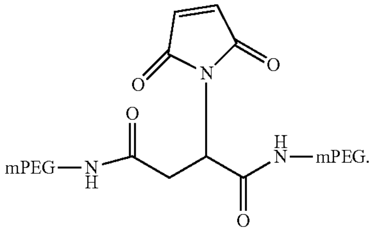

In certain embodiments, the reaction to conjugate the PEG to the aptamer is carried out between about pH 6 and about pH 10, or between about pH 7 and pH 9 or about pH 8.

In certain embodiments, the reagents used to generate PEGylated aptamers or bispecific aptamers may include reagents having the following structure:

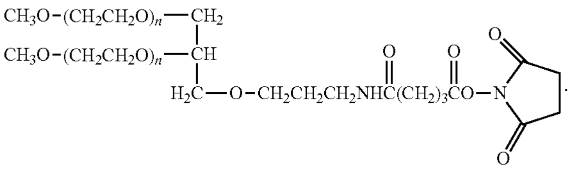

In certain embodiments, the reagents used to generate PEGylated aptamers may include reagents having the following structure:

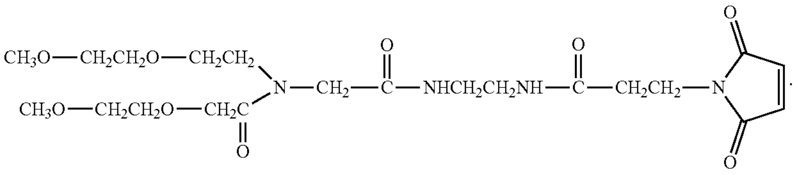

In certain embodiments, the reagents used to generate PEGylated aptamers may include reagents having the following structure:

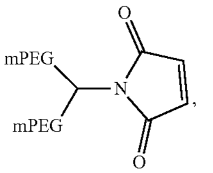

where each mPEG is about 10 kD, about 20 kD, or about 30 kD and the total molecular weight is about 20 kD, about 40 kD, or about 60 kD, respectively. Branched PEGs with thiol reactive groups that can be used with a thiol-modified linker, as described above, may include reagents in which the branched PEG has a total molecular weight of about 40 kD or about 60 kD (e.g., where each mPEG is about 20 kD or about 30 kD).

In certain embodiments, the reagents used to generate PEGylated aptamers may include reagents having the following structure:

In certain embodiments, the reagents used to generate PEGylated aptamers may include reagents having the following structure:

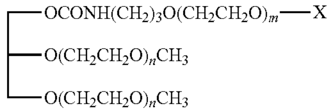

Total Mw 50 kDa

Mw of $(CH_2CH_2O)_m$ part: about 10 kDa

Mw of $(CH_2CH_2O)_n$ part: about 20 kDa (X = Aldehyde, Amine, Aminoxy, Maleimide, NHS, p-Nitrophenyl carbonate)

In certain embodiments, the reagents used to generate PEGylated aptamers may include reagents having the following structure:

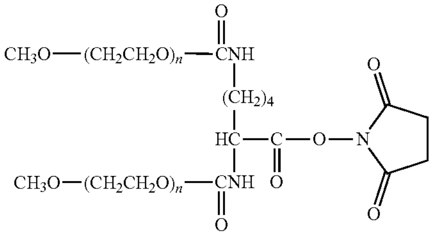

In certain embodiments, the reagents used to generate PEGylated aptamers may include reagents having the following structure:

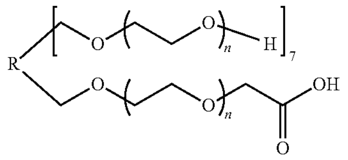

R = Hexaglycerol core structure

In certain embodiments, the reagents used to generate PEGylated aptamers may include reagents having the following structure:

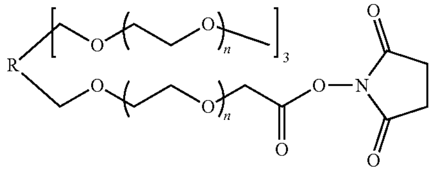

R = Pentaerythritol core structure

In certain embodiments, the aptamer is associated with a single PEG molecule. In other cases, the aptamer or bispecific aptamer is associated with two or more PEG molecules.

In certain embodiments, the aptamers or bispecific aptamers described herein may be bound or conjugated to one or more molecules having desired biological properties. Any number of molecules can be bound or conjugated to aptamers, non-limiting examples including antibodies, peptides, proteins, carbohydrates, enzymes, polymers, drugs, small molecules, gold nanoparticles, radiolabels, fluorescent labels, dyes, haptens (e.g., biotin), other aptamers, or nucleic acids (e.g., siRNA). In certain embodiments, aptamers may be conjugated to molecules that increase the stability, the solubility or the bioavailability of the aptamer. Non-limiting examples include polyethylene glycol (PEG) polymers, carbohydrates and fatty acids. In certain embodiments, molecules that improve the transport or delivery of the aptamer may be used, such as cell penetrating peptides. Non-limiting examples of cell penetrating peptides can include peptides derived from Tat, penetratin, polyarginine peptide Args sequence, Transportan, VP22 protein from Herpes Simplex Virus (HSV), antimicrobial peptides such as Buforin I and SynB, polyproline sweet arrow peptide molecules, Pep-1 and MPG. In some embodiments, the aptamer is conjugated to a lipophilic compound such as cholesterol, dialkyl glycerol, diacyl glycerol, or a non-immunogenic, high molecular weight compound or polymer such as polyethylene glycol (PEG) or other water-soluble pharmaceutically acceptable polymers including, but not limited to, polyaminoamines (PAMAM) and polysaccharides such as dextran, or polyoxazolines (POZ).

The molecule to be conjugated can be covalently bonded or can be associated through non-covalent interactions with the aptamer of interest. In one example, the molecule to be conjugated is covalently attached to the aptamer or bispecific aptamer. The covalent attachment may occur at a variety of positions on the aptamer, for example, to the exocyclic amino group on the base, the 5-position of a pyrimidine nucleotide, the 8-position of a purine nucleotide, the hydroxyl group of the phosphate, or a hydroxyl group or other group at the 5' or 3' terminus. In one example, the covalent attachment is to the 5' or 3' hydroxyl group of the aptamer.

Hydrodynamic Radius

An advantage for a bispecific aptamer over a co-administration or co-formulation is the increase in hydrodynamic radius. Molecular size is a key attribute for lowering diffusion from the eye. Molecular size can be measured in two ways, molecular weight, and hydrodynamic radius ($R_h$). For molecules with larger hydrodynamic radius, there is a great correlation between the physical size of the molecule while in the eye and its clearance rate.

Figure 2:
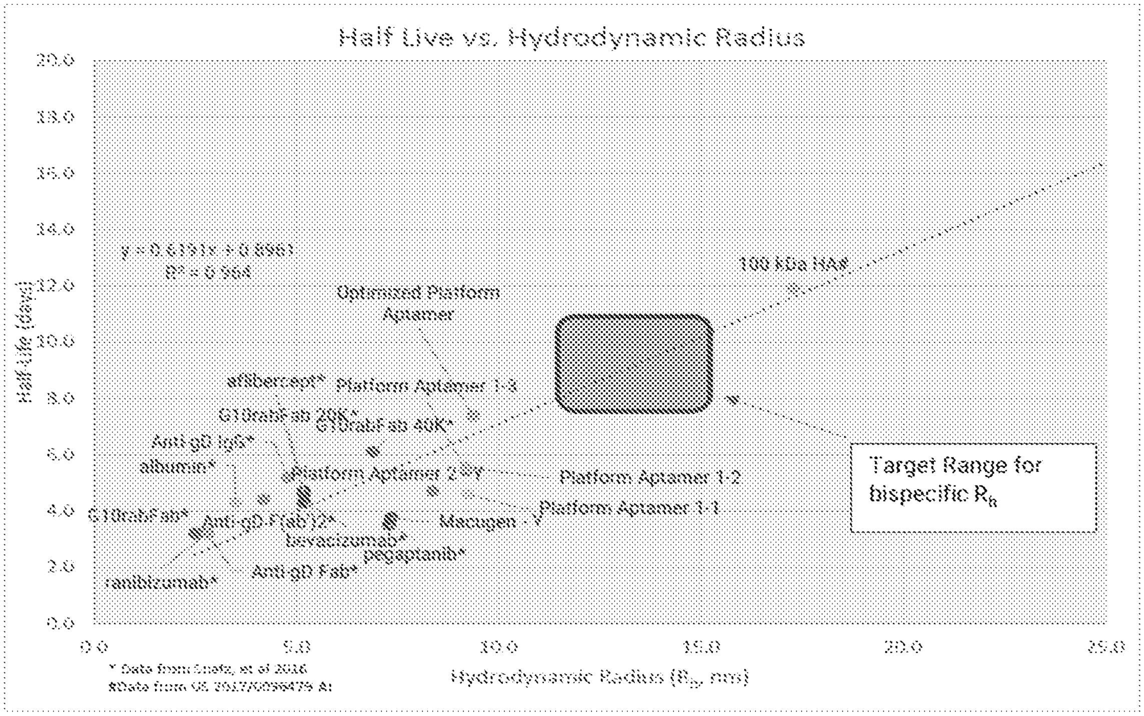
FIG. 2: Depicts a plot of the experimentally derived relationship between molecular hydrodynamic radius and the intravitreal half-life. The target range for a bispecific aptamer is indicated.

The aptamers shown on FIG. 2 are all single aptamers conjugated to a PEG carrier for pharmacokinetic (PK) extension. The ability to make the aptamer portion larger due to the addition of a second aptamer domain prior to adding PEG will provide several advantages. Shatz et al. has shown that larger $R_h$ results in a longer half-life in rabbits. In turn this longer half-life in rabbits reliably translates to a longer half-life in humans. The larger $R_h$ for the bispecific combined with high solubility gives the bispecific aptamer compositions an advantage over current antibody and antibody fragment products. The ability to then conjugate to PEG molecules as needed will provide an even longer boost to duration.

Linkers

In certain embodiments, the aptamer or bispecific aptamer can be attached to another molecule directly or with the use of a spacer or linker. For example, a lipophilic compound or a non-immunogenic, high molecular weight compound can be attached to the aptamer using a linker or a spacer. Various linkers and attachment chemistries are known in the art. In a non-limiting example, 6-(trifluoroacetamido)hexanol (2-cyanoethyl-N,N-diisopropyl)phosphoramidite can be used to add a hexylamino linker to the 5' end of the synthesized aptamer. This linker, as with the other amino linkers provided herein, once the group protecting the amine has been removed, can be reacted with PEG-NHS esters to produce covalently linked PEG-aptamers. Other non-limiting examples of linker phosphoramidites may include: TFA-amino C4 CED phosphoramidite having the structure:

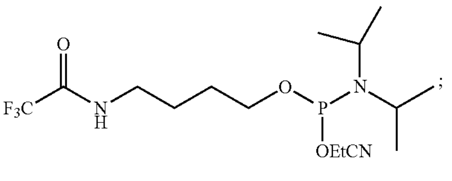

5'-amino modifier C3 TFA having the structure:

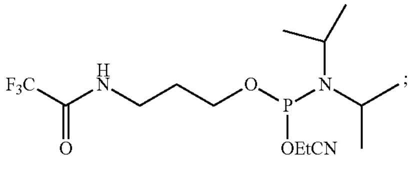

MMT amino modifier C6 CED phosphoramidite having the structure:

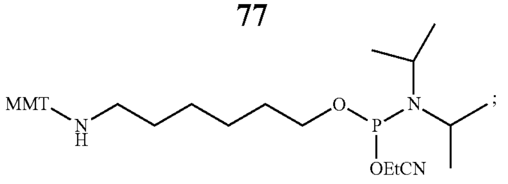

5'-amino modifier 5 having the structure:

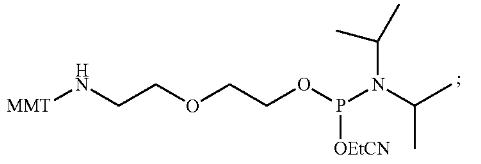

MMT: 4-Monomethoxytrityl

5'-amino modifier C12 having the structure:

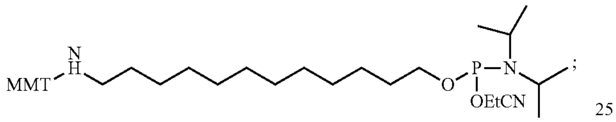

MMT: 4-Monomethoxytrityl

5' thiol-modifier C6 having the structure:

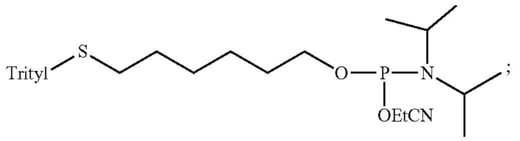

5' thiol-modifier C6 having the structure:

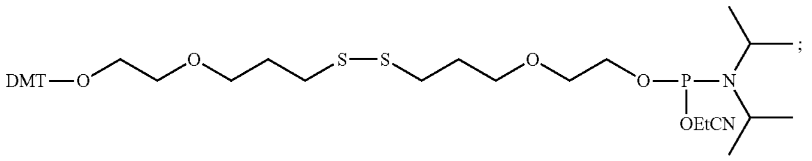

DMT: 4,4'-Dimethoxytrityl and 5' thiol-modifier C6 having the structure:

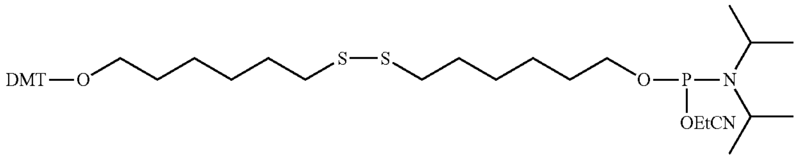

DMT: 4,4'-Dimethoxytrityl

The 5'-thiol modified linker may be used, for example, with PEG-maleimides, PEG-vinylsulfone, PEG-iodoacetamide and PEG-orthopyridyl-disulfide. In one example, the aptamer may be bonded to the 5'-thiol through a maleimide or vinyl sulfone functionality.

In certain embodiments, the aptamer or bispecific aptamer formulated according to the present disclosure may also be modified by encapsulation within or displayed on the surface of a liposome. In other cases, the aptamer formulated according to the present disclosure may also be modified by encapsulation within or displayed on the surface of a micelle. Liposomes and micelles may be comprised of any lipids, and in certain embodiments the lipids may be phospholipids, including phosphatidylcholine. Liposomes and micelles may also contain or be comprised in part or in total of other polymers and amphipathic molecules including PEG conjugates of poly lactic acid (PLA), poly DL-lactic-co-glycolic acid (PLGA), or poly caprolactone (PCL).

VI. Pharmaceutical Compositions and Formulations

Also disclosed are aptamers or bispecific aptamers prepared as pharmaceutical compositions. Compositions as described herein may comprise a liquid formulation, a solid formulation or a combination thereof. Non-limiting examples of formulations may include a tablet, a capsule, a gel, a paste, a liquid solution and a cream. The compositions of the present disclosure may further comprise any number of excipients. Excipients may include any and all solvents, coatings, flavorings, colorings, lubricants, disintegrants, preservatives, sweeteners, binders, diluents, and vehicles (or carriers). Generally, the excipient is compatible with the therapeutic compositions of the present disclosure. The pharmaceutical composition may also contain minor amounts of non-toxic auxiliary substances such as wetting or emulsifying agents, pH buffering agents, and other substances such as, for example, sodium acetate, and triethanolamine oleate.

Therapeutic doses of formulations disclosed herein can be administered to a subject in need thereof. In certain embodiments, a formulation is administered to the eye of a subject to treat, for example, wet AMD, diabetic retinopathy, diabetic macular edema, retinal vein occlusion, branched retinal vein occlusion, central retinal vein occlusion, retinopathy of prematurity, radiation retinopathy, dry AMD, or geographic atrophy. Administration to the eye can be a) topical; b) local ocular delivery; or c) systemic. A topical formulation can be applied directly to the eye (e.g., eye drops, contact lens loaded with the formulation) or to the eyelid (e.g., cream, lotion, gel). In certain embodiments, topical administration can be to a site remote from the eye, for example, to the skin of an extremity. This form of administration may be suitable for targets that are not produced directly by the eye. In certain embodiments, a formulation of the disclosure is administered by local ocular delivery. Non-limiting examples of local ocular delivery include intravitreal (IVT), intracamarel, subconjunctival, subtenon, suprachoroidal, retrobulbar, posterior juxtascleral, and peribulbar. In certain embodiments, a formulation of the disclosure is delivered by intravitreal administration (IVT). Local ocular delivery may generally involve injection of a liquid formulation. In other cases, a formulation of the disclosure is administered systemically. Systemic administration can involve oral administration. In certain embodiments, systemic administration can be intravenous administration, subcutaneous administration, infusion, implantation, and the like.

Other formulations suitable for delivery of the pharmaceutical compositions described herein may include a sustained release gel or polymer formulations by surgical implantation of a biodegradable microsize polymer system, e.g., microdevice, microparticle, or sponge, or other slow release transscleral devices, implanted during the treatment of an ophthalmic disease, or by an ocular delivery device, e.g. polymer contact lens sustained delivery device. In certain embodiments, the formulation is a polymer gel, a self-assembling gel, a durable implant, an eluting implant, a biodegradable matrix or biodegradable polymers. In certain embodiments, the formulation may be administered by iontophoresis using electric current to drive the composition from the surface to the posterior of the eye. In certain embodiments, the formulation may be administered by a surgically implanted port with an intravitreal reservoir, an extra-vitreal reservoir or a combination thereof. Examples of implantable ocular devices can include, without limitation, the Durasert® technology developed by Bausch & Lomb, the ODTx device developed by On Demand Therapeutics, the Port Delivery System developed by ForSight VISION4 and the Replenish MicroPump® System developed by Replenish, Inc.

In certain embodiments, nanotechnologies can be used to deliver the pharmaceutical compositions including nanospheres, nanoparticles, nanocapsules, liposomes, nanomicelles and dendrimers.

The composition disclosed herein can be administered once or more than once each day. In certain embodiments, the composition is administered as a single dose (i.e., one-time use). In this example, the single dose may be curative. In other cases, the composition may be administered serially (e.g., taken every day without a break for the duration of the treatment regimen). In certain embodiments, the treatment regime can be less than a week, a week, two weeks, three weeks, a month, or greater than a month. In certain embodiments, the composition is administered once over a period of at least 12 weeks. In certain embodiments, the composition is administered once over a period of at least 16 weeks. In certain embodiments, the composition is administered once over a period of at least 20 weeks. In certain embodiments, the composition is administered once over a period of at least 24 weeks. In certain embodiments, the composition is administered once over a period of at least 28 weeks. In certain embodiments, the composition is administered once over a period of at least 32 weeks. In certain embodiments, the composition is administered once over a period of at least 36 weeks. In certain embodiments, the composition is administered once over a period of at least 40 weeks. In certain embodiments, the composition is administered once over a period of at least 44 weeks. In certain embodiments, the composition is administered once over a period of at least 48 weeks. In certain embodiments, the composition is administered once over a period of at least 52 weeks. In certain embodiments, the composition is administered as a loading dose of one injection every four weeks for three months Bispecific aptamer compositions as described herein may be particularly advantageous over current approaches as they may sustain therapeutic intravitreal concentrations of drug for longer periods of time, thus requiring less frequent administration. For example, an anti-VEGF-A antibody or Fab may show clinical efficacy for the treatment of wet age-related macular degeneration at 10 mg when dosed every 4 weeks (q4w) but not every 8 weeks (q8w). The bispecific aptamers described herein have a longer intraocular half-life, and/or sustain therapeutic intravitreal concentrations of drug for longer periods of time, than an anti-VEGF-A antibody or Fab and other antibody therapies and thus, can be dosed less frequently. In certain embodiments, the bispecific aptamers are dosed at least every 4 weeks (q4w), every 5 weeks (q5w), every 6 weeks (q6w), every 7 weeks (q7w), every 8 weeks (q8w), every 9 weeks (q9w), every 10 weeks (q10w), every 11 weeks (q11w), every 12 weeks (q12w), every 13 weeks (q13w), every 14 weeks (q14w), every 15 weeks (q15w), every 16 weeks (q16w), every 17 weeks (q17w), every 18 weeks (q18w), every 19 weeks (q19w), every 20 weeks (q20w), every 21 weeks (q21w), every 22 weeks (q22w), every 23 weeks (q23w), every 24 weeks (q24w) or greater than q24w.

The compositions herein may include any number of pharmaceutical compositions for the treatment of ocular diseases or disorders as well as any type of formulation containing a PEGylated bispecific aptamer composition provided herein. The pharmaceutical compositions may include a therapeutically effective amount of any composition as described herein (e.g., a therapeutic bispecific aptamer conjugated to a PEG reagent). In certain embodiments, the formulation or pharmaceutical composition provided herein contains a PEGylated bispecific aptamer provided herein and another substance or component provided herein, such as a liquid or buffer.

In certain embodiments, the pharmaceutical composition or formulation is solely composed of PEGylated bispecific aptamers. In other cases, the formulation or pharmaceutical composition is substantially composed of PEGylated bispecific aptamers (e.g., greater than about 70%, greater than about 80%, greater than about 90%, greater than about 95% composed of PEGylated bispecific aptamers). In other cases, the formulation or pharmaceutical composition is mostly composed of PEGylated bispecific aptamers (e.g., greater than about 50% PEGylated aptamers). In certain embodiments, the PEGylated bispecific aptamer is a minor constituent of the pharmaceutical formulation. In certain embodiments, the PEGylated bispecific aptamer makes up less than about 20%, less than about 10%, or less than about 5% of the pharmaceutical formulation or composition. In certain embodiments, the PEGylated bispecific aptamer makes up from about 3% to about 5% of the pharmaceutical formulation or composition.

The formulation or pharmaceutical composition may further include any number of excipients, vehicles or carriers. For example, the pharmaceutical composition may include a therapeutically effective amount of the bispecific composition, alone or in combination, with one or more vehicles (e.g., pharmaceutically acceptable compositions or e.g., pharmaceutically acceptable carriers). Excipients may include any and all buffers, solvents, lubricants, preservatives, diluents, and vehicles (or carriers). Generally, the excipient is compatible with the compositions described herein. The pharmaceutical composition may also contain minor amounts of non-toxic auxiliary substances such as wetting or emulsifying agents, pH buffering agents, and other substances such as, for example, sodium acetate, and triethanolamine oleate.

In certain embodiments, a therapeutically effective amount of the bispecific composition is administered to a subject. The term "therapeutically effective amount" refers to an amount of the composition that provokes a therapeutic or desired response in a subject. In certain embodiments, the therapeutic or desired response is the alleviation or reduction of one or more symptoms associated with a disease or disorder. In certain embodiments, a therapeutic or desired response is prophylactic treatment of a disease or a disorder. The therapeutically effective amount of the composition may be dependent on the route of administration. In the case of systemic administration, a therapeutically effective amount may be about 10 mg/kg to about 100 mg/kg. In certain embodiments, a therapeutically effective amount may be about 10 μg/kg to about 1000 μg/kg for systemic administration. For intravitreal administration, a therapeutically effective amount can be about 0.01 mg to about 150 mg in about 25 μl to about 100 μl injection volume per eye.

The pharmaceutical compositions may be administered in a dose that is sufficient to cause a therapeutic benefit to or a therapeutic response in the subject. The dose may vary depending on a variety of factors including the bispecific aptamer and the PEG reagent selected for use. In certain embodiments, a therapeutically effective amount of a PEGylated bispecific aptamer of the disclosure (e.g., a bispecific aptamer attached to a PEG having 2, 3 or more arms) may be administered to a subject in a relatively small volume. In certain embodiments, a therapeutically effective amount of a bispecific aptamer attached to a PEG reagent having 2 or more arms may be administered to a subject in a smaller volume than a bispecific aptamer attached to a PEG reagent having less than 2 arms. In certain embodiments, a therapeutically effective amount of a bispecific aptamer attached to a PEG reagent having 3 or more arms may be administered to a subject in a smaller volume than a bispecific aptamer attached to a PEG reagent having less than 3 arms. For example, because of the surprising benefits of using a PEG reagent having 3 or more arms (e.g., lower viscosity, higher injectability, etc.), a formulation comprising a PEGylated bispecific aptamer of the disclosure may be more concentrated (and hence, require a smaller administration volume). In certain embodiments, the therapeutic composition/formulation may enable a therapeutically effective amount to be delivered to a subject in a single administration, e.g., a single injection, a single intravitreal injection. In certain embodiments, the therapeutic composition/formulation may possess a viscosity that enables a therapeutically effective amount to be delivered to a subject in a single administration, e.g., a single injection, a single intravitreal injection.

In certain embodiments, a therapeutically effective amount of an aptamer attached to a PEG reagent having 3 or more arms (e.g., 3 or more arms, 4 or more arms, etc.) may be less than a therapeutically effective amount of a bispecific aptamer attached to a PEG reagent having two or less arms. Without wishing to be bound by theory, this may be because an increased intravitreal retention time may reduce the amount of PEGylated bispecific aptamer needed to achieve a therapeutic response.

The pharmaceutical compositions herein generally may be administered by injection to the vitreous (i.e., intravitreal (IVT) administration). IVT administration may be to one eye if only one eye is affected by the ocular disease, or to both eyes if both eyes are affected. The pharmaceutical compositions herein may be in a formulation suitable for intravitreal administration. For example, the pharmaceutical compositions may be prepared in a liquid formulation for injection into the vitreous.

Liquid formulations provided herein may have low viscosity, e.g., a viscosity amenable to intravitreal injection, yet may also contain a relatively high concentration of PEGylated bispecific aptamer (e.g., about 25 mg/mL to about 60 mg/mL). In certain embodiments, the pharmaceutical composition may comprise a PEGylated bispecific aptamer concentration of at least about 25 mg/mL, at least about 30 mg/mL, at least 35 mg/mL, at least 40 mg/mL, at least 45 mg/mL, at least 50 mg/mL or at least 60 mg/mL). In a specific example, a liquid formulation provided herein may have an aptamer concentration of PEGylated bispecific aptamer of greater than about 25 mg/ml or greater than about 30 mg/ml when formulated for intravitreal administration. In another specific example, a liquid formulation provided herein may have an aptamer concentration of PEGylated bispecific aptamer of greater than about 35 mg/ml when formulated for intravitreal administration. In another specific example, a liquid formulation provided herein may have an aptamer concentration of PEGylated bispecific aptamer of greater than about 40 mg/ml when formulated for intravitreal administration.

In certain embodiments, a liquid formulation as provided herein may be formulated in a pre-filled syringe. In certain embodiments, a liquid formulation may be formulated in a volume of about 10 μL, about 20 μL, about 30 μL, about 40 μL, about 50 μL, about 60 μL, about 70 μL, about 80 μL, about 90 μL, about 100 μL or greater than about 100 μL. Also provided herein are pre-filled syringes that contain a composition that comprises any of the PEGylated bispecific aptamers described herein.

As used herein, "polydispersity index" refers to a measure of the distribution of molecular mass in a given polymer sample. The polydispersity index, therefore, reflects the level of uniformity in a sample. The polydispersity index (PDI) of a solution may be calculated by the following formula: PDI=Mw/Mn, where Mw is the weight average molecular weight, and Mn is the number average molecule weight. Therefore, the greater the PDI of a solution, the broader the distribution of molecular mass within the sample. In certain embodiments, the therapeutic compositions provided herein may have a PDI of less than 1.05. That is, the molecular mass of PEGylated bispecific aptamers present in a therapeutic composition of the disclosure may be relatively uniform. In certain embodiments, the PDI of a therapeutic bispecific composition may be less than about 1.05, less than about 1.04, less than about 1.03, less than about 1.02, less than about 1.01, or about 1.00.

The compositions described herein may be co-administered with one or more additional therapeutic agents. The one or more additional therapeutic agents may be conjugated to a PEG reagent as described herein or may be unconjugated. The one or more additional therapeutic agents enhance or act synergistically in combination with the compositions provided herein.

The PEGylated bispecific aptamer may be administered to a subject by ocular delivery. In one embodiment, the PEGylated bispecific aptamer is administered by intravitreal injection. In one embodiment, the PEGylated bispecific aptamer is administered by periocular injection. In one embodiment, the PEGylated bispecific aptamer is administered by suprachoroidal injection. In one embodiment, the PEGylated bispecific aptamer is administered by subretinal injection.

In one embodiment the bispecific aptamer composition will be formulated in a prefilled syringe. In one embodiment, the prefilled syringe will be designed to deliver 50-100 uL. In one embodiment, the prefilled syringe will have a final total volume of 500 uL. In one embodiment, the prefilled syringe will be end sterilized prior to filling. In one embodiment, the barrel of the syringe is borosilicate glass type I with no printing. In one embodiment, the needle size will be 31 G. In one embodiment, the needle size will be 30 G. In one embodiment, the needle size will be 29 G. In one embodiment, the needle size will be 28 G. In one embodiment, the needle size will be 27 G. In one embodiment, the needle gauge will be large enough to produce an injection break force of less than 12 N. In one embodiment, the needle length will be approximately 12-13 mm. In one embodiment, the prefilled syringe will be siliconized, to ensure smooth glide for the stopper during injections.

VII. General Method of Preparation

Figure 3:
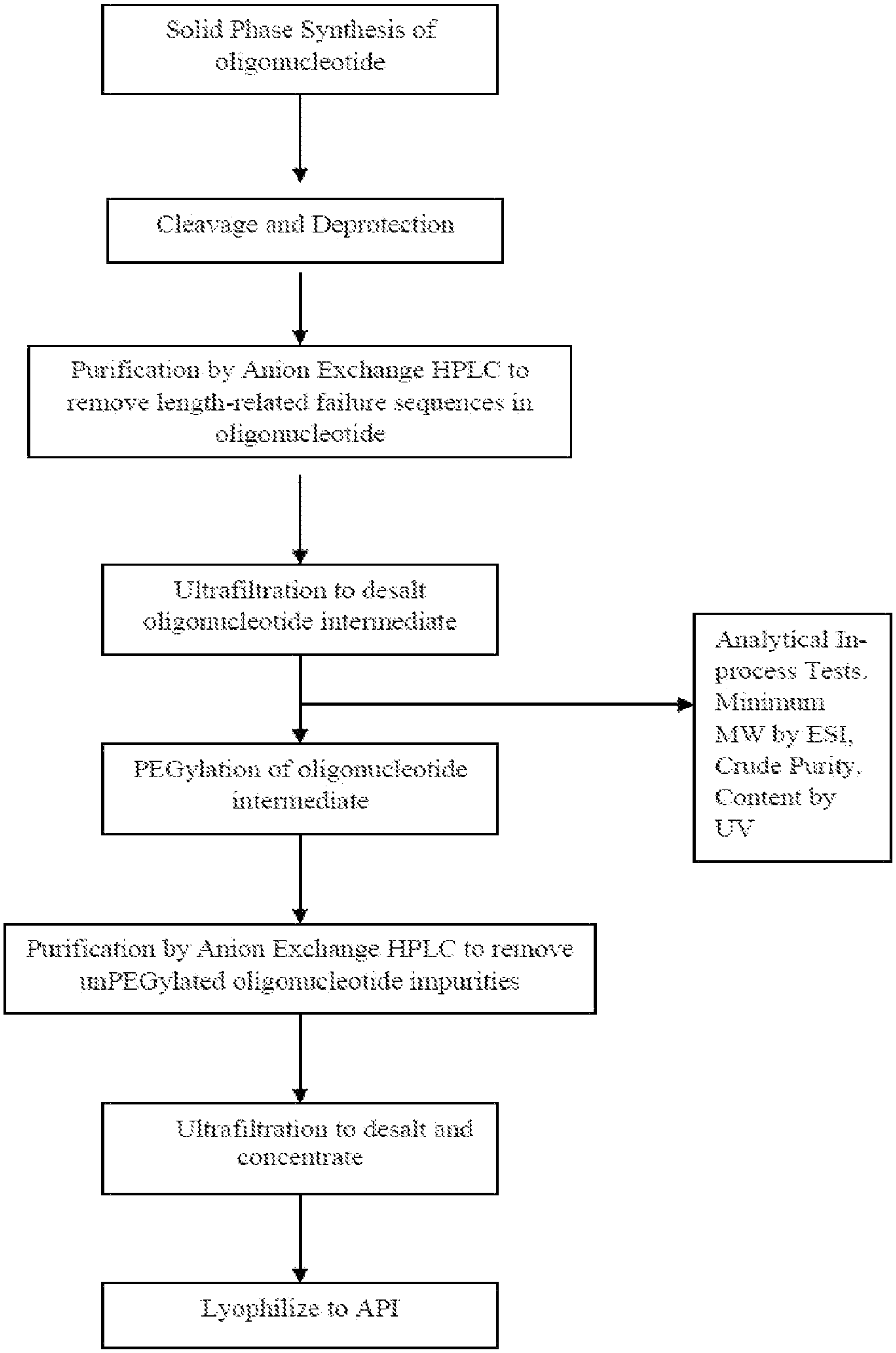
FIG. 3: Depicts a flow diagram illustrating the steps involved in the synthesis, deprotection, PEGylation and purification of a bispecific aptamer by direct chemical synthesis.

Oligonucleotide synthesis is a multi-step process involving solid phase chemical synthesis of the oligonucleotide strand; cleavage and deprotection of the crude oligonucleotide; purification by preparative anion exchange chromatography; desalting followed by PEGylation; purification of the PEGylated oligonucleotide by preparative anion exchange chromatography to remove unPEGylated oligonucleotide impurities; ultrafiltration for desalting; concentration and lyophilization of the final product. The entire process is schematically shown in the process flow diagram in FIG. 3.

Chemical Synthesis

Chemical synthesis of oligonucleotides via phosphoramidite chemistry involves sequential coupling of activated monomers to an elongating polymer, one terminus of which is covalently attached to a solid support matrix. The solid phase approach allows for easy purification of the reaction product at each step in the synthesis by simple solvent washing of the solid phase. The oligonucleotides are sequentially assembled from the 3'-end towards the 5'-end by deprotecting the 5'-end of the support-bound molecule, allowing the support-bound molecule to react with an incoming tetrazole-activated phosphoramidite monomer, oxidizing the resulting phosphite triester to a phosphate triester, and blocking any unreacted hydroxyl groups by acetylation (capping) to prevent non-sequential coupling with the next incoming monomer to form a "deletion sequence". This sequence of steps is repeated for subsequent coupling reactions until the full-length oligonucleotides are synthesized. Due to the presence of a 3'-3' linkage at the 3' end and a C-6 linker for PEGylation at the 5' end, the synthesis is modified at the first and last step to accommodate these changes.

Cleavage and Deprotection

Upon completion of the synthesis, the solid-support and associated oligonucleotide are transferred to a filter funnel, dried under vacuum and transferred to a reaction vessel. Ammonium hydroxide (28-30%) and methylamine (40% in water) are added to the solid support as a 1:1 solution (AMA) and the mixture is heated to approximately 45-60° C. for approximately 30 minutes to effect cleavage from the solid support, removal of the cyanoethyl phosphate protecting group, deprotection of exocyclic amine protecting groups as well as removal of the trifluoroacetyl group from the linker. The sample is cooled at −20° C. for 30 minutes to yield the crude oligonucleotide. The mixture is filtered under vacuum to remove the waste solid support. The reaction is quenched with glacial acetic acid to provide a pH neutral solution of crude product.

Anion Exchange Purification 1

The crude oligonucleotide is purified by preparative anion exchange chromatography. Purification is accomplished by eluting the product from the column through a controlled increase in sodium bromide concentration in the buffer system by increasing the proportion of Buffer B. Fractions are collected and analyzed by UV and IP RP-HPLC. Fractions are combined to yield a product pool of the desired purity, desalted by ultrafiltration and concentrated. The concentrated product is labeled and stored at 2-8° C.

The purified oligonucleotide intermediate is analyzed for MW by ES-MS, UV for oligonucleotide content and purity by IP RP-HPLC prior to proceeding to the PEGylation step.

PEGylation

The purified and concentrated oligonucleotide intermediate from above is reacted with 40K PEG at 25° C. in 0.1-0.2 M sodium borate buffer (~pH 8.8-9.8), DMSO, and acetonitrile for 60-90 min.

Anion Exchange Purification 2

The crude product is purified by preparative anion exchange chromatography to remove unPEGylated oligomer impurities. Purification is accomplished by eluting the product from the column through a controlled increase in sodium bromide concentration in the buffer system by increasing the proportion of Buffer B. Fractions are collected and analyzed for content and purity. Selected fractions are combined to yield a product pool of the desired purity.

Desalting and Concentration

The pooled fractions are desalted by ultrafiltration and concentrated. The concentrated product is labeled and stored at 2-8° C.

Lyophilization

API is aliquoted then freeze-dried to a dry, off-white to slightly yellow powder.

Storage of API

Lyophilized API is stored at −15° C. to −25° C.

Figure 4:
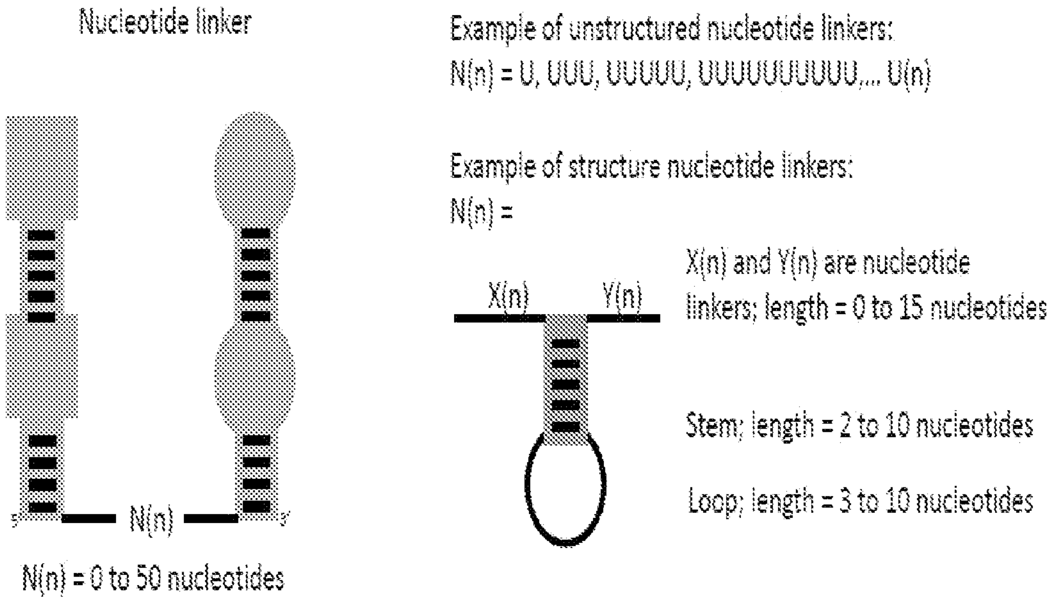
FIG. 4: Depicts examples, approaches and parameters to link two aptamers by a nucleotide linker N(n). Two different aptamer domains can be linked by a linker comprised of nucleotides. The length of the linker can vary from 0 to 50 nucleotides in length. The linker can be unstructured (exemplary linker UUUUUUUUUU, SEQ ID NO: 447) or structured (e.g., designed to form a stem loop). When designed to form a stem loop the length of the stem can be varied from 2 to 10 nucleotides and then loop length varied from 3 to 10 nucleotides. A structured stem linker can be flanked by nucleotide linkers (X(n) and Y(n)) that are between 0 and 15 nucleotides in length.

Example 1: Bispecific Aptamers Targeting VEGF and IL8 Generated by Direct Chemical Synthesis An aptamer domain targeting VEGF and an aptamer domain targeting IL8 can be linked directly during solid phase chemical synthesis (FIGS. 4-6). To achieve this the anti-VEGF aptamer (aptamer 285 (SEQ ID NO: 1); CXACZCCGCGCGGAGGGXUUU-CAUAAUCCCGUUUXUCX, where A, C and U are 2'OMe, G is 2'F G, X is 2'OMe G and Z is the 3-carbon non-nucleotidyl spacer is 1,3-propanediol) is linked at the 5' end of a short nucleotide linker composed of five 2'OMe Uridine residues (UUUUU; where U is 2'OMe U), which in turn is linked to the 5' end of the anti-IL8 aptamer (aptamer 269 (SEQ ID NO: 48); XXCXACXXUAX-AUUAUGGGCAGUGUGACCXCXCC, where A, C and U are 2'OMe, G is 2'F G, X is 2'OMe G). The resulting bispecific aptamer sequence (SEQ ID NO: 60); (CX-ACZCCGCGCGGAGGGXUUU-CAUAAUCCCGUUUXUCXUUUUU XXCXACXXUAX-AUUAUGGGCAGUGUGACCXCXCC) where A, C and U are 2'OMe, G is 2'F G, X is 2'OMe G and Z is the 3-carbon non-nucleotidyl spacer is 1,3-propanediol) can be synthesized using a combination of commercially available 2'-fluoro-G and 2'-O-methyl (2'OMe) A/C/U/G modified phosphoramidites on a 3' inverted deoxythymidine CPG support. The 5' end of the aptamer is modified with a 5' C6 amino modifier to facilitate conjugation to an activated PEG moiety.

Following synthesis, the bispecific aptamer is deprotected using the appropriate solvents and reagents capable of removing the phosphate protecting groups, removing the base protecting groups and cleaving the molecule from the support. For example, the bispecific aptamer could be treated with diethylamine in acetonitrile followed by aqueous 30% ammonium hydroxide or a 50/50 mixture of aqueous 30% ammonium hydroxide and 40% methyl ammonium hydroxide. The deprotected bispecific aptamer is then desalted and used for PEG conjugation directly without additional purification.

Conjugation to a 40 kDa branched PEG is achieved by incubating the 5' amine modified bispecific aptamer with a 1.5-5-fold molar excess of NHS activated SUNBRIGHT® GL2-400GS2 in 0.1M sodium bicarbonate buffer at pH 8.5. Following incubation, typically 2-20 hr, the PEGylated bispecific aptamer is purified by either anion exchange chromatography or ion paired reverse phase chromatography. The PEGylated bispecific aptamer is subsequently desalted prior to future use.

In some instances, the deprotected bispecific aptamer is purified by either anion exchange chromatography or ion paired reverse phase chromatography prior to PEG conjugation. Following purification, the bispecific aptamer is desalted into water and then combined with a 1.5-5 fold molar excess of NHS activated SUNBRIGHT® GL2-400GS2 in 0.1M sodium bicarbonate buffer at pH 8.5. Following incubation, typically 2-20 hr, the PEGylated bispecific aptamer is then purified by either anion exchange chromatography or ion paired reverse phase chromatography. The PEGylated bispecific aptamer is subsequently desalted prior to future use.

A number of variations to this approach can be utilized to achieve the same or similar end products. For example, the orientation of the aptamers could be reversed. That is, the bispecific aptamer could be constructed bearing a 5' anti-VEGF domain and a 3' anti-IL8 domain or a 5' anti-IL8 domain and a 3' anti-VEGF domain. Similarly, the length of the nucleotide linker or the sequence of the linker could be changed and that this would impart changes in the distance and/or geometry between the aptamer domains.

The bispecific aptamers generated using this approach could be linked with a non-nucleotidyl linker. Numerous non-nucleotidyl linkers are available commercially as phosphoramidtes. Other similar linkers can be readily synthesized using standard chemical approaches. The nucleotidyl linker could be, a 3-carbon non-nucleotidyl spacer such as 1,3-propanediol, a 6-carbon non-nucleotidyl spacer such as 1,6-hexanediol, a 9-atom spacer such as triethyleneglycol or an 18-atom spacer such as hexaethyleneglycol.

The approach can be applied to any combination of aptamers, in particular those in Table 27.

TABLE 27

| SEQ ID NO: | Aptamer | Target | Sequence |
|---|---|---|---|
| 1 | 285 | VEGF | CXACZCCGCGCGGAGGGXUUUCAUAAUCC CGUUUXUCX |
| 2 | 26 | VEGF | AGGCCGCCUCCGCGCGGAGGGGUUUCAUU AUCCCGUUUGGCGGCUU |
| 3 | 439 | VEGF | CGACUCCGCGCGGAGGGUUGGAGGUUACC CGUUUGUCG |
| 4 | 441 | VEGF | CGACUCCGCGCGGAGUCCCUAAUUUGGGG CGUUUGUCG |
| 5 | 443 | VEGF | CGACUCCGCGCGGAGUCCCUUCAUUGGGG CGUUUGUCG |
| 6 | 445 | VEGF | CGACUCCGCGCGGAGGGUUAAUGGCUACC CGUUUGUCG |
| 7 | 447 | VEGF | CGACUCCGCGCGGAGUCCCUGUAAUGGGG CGUUUGUCG |
| 8 | 479 | VEGF | CGACUCCGCGCGGAGGGUUUGGCUACCCG UUUGUCG |
| 9 | 481 | VEGF | CGACUCCGCGCGGAGGCUUGAGGUAGCCG UUUGUCG |
| 10 | 483 | VEGF | CGACUCCGCGCGGAGUCCCACAUGGGGCG UUUGUCG |
| 11 | 485 | VEGF | CGACUCCGCGCGGAGGGAUGAGGUUCCCG UUUGUCG |
| 12 | 487 | VEGF | CGACUCCGCGCGGAGGCAUGAGGUUGCCG UUUGUCG |
| 13 | 489 | VEGF | CGACUCCGCGCGGAGUGCUGAGGUGCACG UUUGUCG |
| 14 | 600 | VEGF | CGACZCCGCGCGGAGGGUUGGAGGUUACC CGUUUGUCG |
| 15 | 601 | VEGF | CGACZCCGCGCGGAGUCCCUAAUUUGGGG CGUUUGUCG |
| 16 | 602 | VEGF | CGACZCCGCGCGGAGUCCCUUCAUUGGGG CGUUUGUCG |
| 17 | 603 | VEGF | CGACZCCGCGCGGAGGGUUAAUGGCUACC CGUUUGUCG |
| 18 | 604 | VEGF | CGACZCCGCGCGGAGUCCCUGUAAUGGGG CGUUUGUCG |
| 19 | 605 | VEGF | CGACZCCGCGCGGAGGGUUUGGCUACCCG UUUGUCG |
| 20 | 606 | VEGF | CGACZCCGCGCGGAGGCUUGAGGUAGCCG UUUGUCG |
| 21 | 607 | VEGF | CGACZCCGCGCGGAGUCCCACAUGGGGCG UUUGUCG |
| 22 | 608 | VEGF | CGACZCCGCGCGGAGGGAUGAGGUUCCCG UUUGUCG |
| 23 | 609 | VEGF | CGACZCCGCGCGGAGGCAUGAGGUUGCCG UUUGUCG |
| 24 | 610 | VEGF | CGACZCCGCGCGGAGUGCUGAGGUGCACG UUUGUCG |
| 25 | 611 | VEGF | CXACUCCGCGCGGAGGGUUGGAGGUUACC CGUUUXUCX |
| 26 | 612 | VEGF | CXACUCCGCGCGGAGUCCCUAAUUUGGGG CGUUUXUCX |

TABLE 27-continued

| SEQ ID NO: | Aptamer | Target | Sequence |
|---|---|---|---|
| 27 | 613 | VEGF | CXACUCCGCGCGGAGUCCCUUCAUUGGGGCGUUUXUCX |
| 28 | 614 | VEGF | CXACUCCGCGCGGAGGGUUAAUGGCUACCCGUUUXUCX |
| 29 | 615 | VEGF | CXACUCCGCGCGGAGUCCCUGUAAUGGGGCGUUUXUCX |
| 30 | 616 | VEGF | CXACUCCGCGCGGAGGGUUUGGCUACCCGUUUXUCX |
| 31 | 617 | VEGF | CXACUCCGCGCGGAGGCUUGAGGUAGCCGUUUXUCX |
| 32 | 618 | VEGF | CXACUCCGCGCGGAGUCCCACAUGGGGCGUUUXUCX |
| 33 | 619 | VEGF | CXACUCCGCGCGGAGGGAUGAGGUUCCCGUUUXUCX |
| 34 | 620 | VEGF | CXACUCCGCGCGGAGGCAUGAGGUUGCCGUUUXUCX |
| 35 | 621 | VEGF | CXACUCCGCGCGGAGUGCUGAGGUGCACGUUUXUCX |
| 36 | 622 | VEGF | CXACZCCGCGCGGAGGGUUGGAGGUUACCCGUUUXUCX |
| 37 | 623 | VEGF | CXACZCCGCGCGGAGUCCCUAAUUUGGGGCGUUUXUCX |
| 38 | 624 | VEGF | CXACZCCGCGCGGAGUCCCUUCAUUGGGGCGUUUXUCX |
| 39 | 625 | VEGF | CXACZCCGCGCGGAGGGUUAAUGGCUACCCGUUUXUCX |
| 40 | 626 | VEGF | CXACZCCGCGCGGAGUCCCUGUAAUGGGGCGUUUXUCX |
| 41 | 627 | VEGF | CXACZCCGCGCGGAGGGUUUGGCUACCCGUUUXUCX |
| 42 | 628 | VEGF | CXACZCCGCGCGGAGGCUUGAGGUAGCCGUUUXUCX |
| 43 | 629 | VEGF | CXACZCCGCGCGGAGUCCCACAUGGGGCGUUUXUCX |
| 44 | 630 | VEGF | CXACZCCGCGCGGAGGGAUGAGGUUCCCGUUUXUCX |
| 45 | 631 | VEGF | CXACZCCGCGCGGAGGCAUGAGGUUGCCGUUUXUCX |
| 46 | 632 | VEGF | CXACZCCGCGCGGAGUGCUGAGGUGCACGUUUXUCX |
| 47 | 248 | IL8 | XCXXUGGGAAAUGUGAGAUGGGUUXCCXC |
| 48 | 269 | IL8 | XXCXACXXUAXAUUAUGGGCAGUGUGACCXCXCC |
| 49 | 188 | Ang2 | XGGCAAAGGCAAAUCAAAACCGUUACAACCC |
| 50 | 204 | Ang2 | ACGGGGCAAUCCUGCCGUUUUACAGGUAAAXCCG |
| 51 | ARC1905 | C5 | CXCCGCXXUCUCAXXCGCUXAXUCUXAXUUUACCUXCX |
| 52 | ARC127 | PDGF | caggcUaCX(S18)cgtaXaXcaUCA(S18)tgatCCUX |
| 53 | 3(19) | FGF2 | XXXAUACUAXX(rG)CAUUAAUXUUACCA(rG)U(rG)UAXUCCC |
| 54 | 74 | FactorD | CCXCCUUGCCAGUAUUGGCUUAGGCUGGAAGUUUXXCXX |

Where G is 2'F RNA, X is 2'OMe G RNA, A, C, and U are 2'OMe RNA, C and U are 2'F RNA, a, g, c and t are DNA, Z is a 1,3-propanediolspacer and (S18) hexaethyleneglycol

Example 2: Synthesis of Bispecific Aptamer Compositions Using Aptamer 285Ex and Aptamer 269

Using this approach, bispecific aptamers were synthesized using aptamer 285ex, an extended version of the anti-VEGF aptamer 285 with an inverted T (SEQ ID NO: 67) combined with the anti-IL8 aptamer 269 with a converted T (SEQ ID NO: 56). Bispecific aptamers were generated using a non-nucleotide linker comprised of a 3-carbon non-nucleotidyl 1,3-propanediol spacer (Z) (SEQ ID NOS: 69 and 398), a non-nucleotide linker comprised of a hexaethylene glycol spacer (S18) (SEQ ID NOS: 70 and 399), or a nucleotide linker composed of five 2'OMe deoxyuridine residues (5U) (SEQ ID NO: 71). The order of the aptamer domains was varied; constructs were made with aptamer 285 linked to the 5' side of aptamer 269, and with aptamer 285 linked to the 3' side of aptamer 269. In all cases, aptamers were generated bearing a 5' a 3' inverted deoxy thymidine (Table 28).

TABLE 28

| SEQ ID NO | 5'Apt | 3'Apt | Linker | Sequence |
|---|---|---|---|---|
| 67 | 285ex | n/a | n/a | **XC**CXACZCCGCGCGGAGGGXUUUCAUAAUCCCGUUUXUCX**XC**-invdT |
| 56 | 269 | n/a | n/a | XXCXACXXUAXAUUAUGGGCAGUGUGACCXCXCC-invdT |
| 69 398 | 285ex | 269 | Z | **XC**CXACZCCGCGCGGAGGGXUUUCAUAAUCCCGUUUXUCX**XC**ZXXCXACXXUAXAUUAUGGGCAGUGUGACCXCXCC-invdT |
| 70 399 | 285ex | 269 | S18 | **XC**CXACZCCGCGCGGAGGGXUUUCAUAAUCCCGUUUXUCX**XC**S18XXCXACXXUAXAUUAUGGGCAGUGUGACCXCXCC-invdT |
| 71 | 285ex | 269 | 5U | **XC**CXACZCCGCGCGGAGGGXUUUCAUAAUCCCGUUUXUCX**XC**-UUUUU-XXCXACXXUAXAUUAUGGGCAGUGUGACCXCXCC-invdT |
| 74 401 | 269 | 285ex | Z | XXCXACXXUAXAUUAUGGGCAGUGUGACCXCXCCZ**XC**CXACZCCGCGCGGAGGGXUUUCAUAAUCCCGUUUXUCX**XC**-invdT |
| 75 402 | 269 | 285ex | S18 | XXCXACXXUAXAUUAUGGGCAGUGUGACCXCXCCS18**XC**CXACZCCGCGCGGAGGGXUUUCAUAAUCCCGUUUXUCX**XC**-invdT |

TABLE 28-continued

| SEQ ID NO | 5'Apt | 3'Apt | Linker | Sequence |
|---|---|---|---|---|
| 76 403 | 269 | 285ex | 5U | XXCXACXXUAXAUUAUGGGCAGUG UGACCXCXCC-UUUUU-**XC**CXACZ CCGCGCGGAGGGXUUUCAUAAUCC CGUUUXUCX**XC**-invdT |

where G is 2'F RNA, X is 2'OMe G RNA, A, C, and U are 2'OMe RNA, C and U are 2' F RNA, a, g, c and t are DNA, Z is a 1,3-propanediol spacer, S18 is hexaethylene glycol
Sequences in bold indicate base pairs added to stabilize a terminal stem

Example 3: Bispecific Aptamers Targeting VEGF and IL8 Generated by Enzymatic Synthesis A bispecific aptamer targeting both VEGF and IL8 can also be generated enzymatically by linking an aptamer domain targeting VEGF and an aptamer domain targeting IL8. To achieve this, the anti-VEGF aptamer (aptamer 26 (SEQ ID NO: 2); AGGCCGCCUCCGCGCGGAGGG-GUUUCAUUAUCCCGUUUGGCGGCUU, where A, C and U are 2'OMe, G is 2'F G) is linked at the 5' end of a short nucleotide linker composed of five 2'OMe Uridine residues (UUUUU; where U is 2'OMe U), which in turn is linked to the 5' end of the anti-IL8 aptamer (aptamer 269 (SEQ ID NO: 48); GGCGACGGUAGAUUAUGGGCAGU-GUGACCGCGCC, where A, C and U are 2'OMe, G is 2'F G, X is 2'OMe G). The resulting bispecific aptamer sequence AGGCCGCCUCCGCGCGGAGGGGUUU-CAUUAUCCCGUUUGGCGGCUU UUUUUGGCGACG-GUAGAUUAUGGGCAGUGUGACCGCGCC (SEQ ID NO: 446) (where A, C and U are 2'OMe, G is 2'F G) can be encoded in a double stranded DNA immediately adjected to the 3' end of a dsDNA phage polymerase promoter. Such templates can be generated by PCR from single stranded DNA template using the appropriate primers. The double stranded DNA template can then be transcribed into modified RNA using the appropriate mutant phage polymerase and nucleotide mixture (e.g. 2'F GTP, 2'OMe ATP, 2'OMe CTP, 2'OMe UTP) and purified by gel electrophoresis, HPLC, or other suitable method.

A number of variations to this approach can be utilized to achieve the same or similar end product. The ordinarily skilled artisan would recognize that the orientation of the domains is not fixed and that the bispecific aptamer could be constructed bearing a 5' anti-VEGF domain and a 3' anti-IL8 domain or a 5' anti-IL8 domain and a 3' anti-VEGF domain. Similarly, the length of the nucleotide linker or the sequence of the linker changed and that this would impart changes in the distance and or special geometry between the aptamer domains. The approach can be applied to any combination of aptamers, in particular those in Table 27.

Example 4: Bispecific Aptamers Targeting VEGF and IL8 Generated by Chemical Synthesis Followed by Domain Chemical Conjugation An aptamer domain targeting VEGF and an aptamer domain targeting IL8 can be synthesized separately using solid phase chemical synthesis and following deprotection and/or purification linked chemically (FIG. 7).

To achieve this the anti-VEGF aptamer (aptamer 285 (SEQ ID NO: 1); CXACZCCGCGCGGAGGGXUUU-CAUAAUCCCGUUUXUCX, where A, C and U are 2'OMe, G is 2'F G, X is 2'OMe G and Z is the 3-carbon non-nucleotidyl spacer is 1,3-propanediol) is synthesized using a combination of commercially available 2'-fluoro-G and 2'-O-methyl (2'OMe) A/C/U/G modified phosphoramidites on a 3' inverted deoxythymidine CPG support bearing a 5' C6 amino modifier to facilitate conjugation. Similarly, the anti-IL8 aptamer (aptamer 269 (SEQ ID NO: 48); XXCXACXXUAXAUUAUGGGCAGU-GUGACCXCXCC, where A, C and U are 2'OMe, G is 2'F G, X is 2'OMe G) is synthesized using a combination of commercially available 2'-fluoro-G and 2'-O-methyl (2'OMe) A/C/U/G modified phosphoramidites on a 3' amine C7 CPG support. The 5' end of the aptamer is modified with a 5' C6SS thiol modifier to facilitate conjugation to an activated PEG moiety.

Following synthesis, the individual aptamers are deprotected using the appropriate solvents and reagents capable of removing the phosphate protecting groups, removing the base protecting groups and cleaving the molecule from the support. For example, the aptamers could be treated with diethylamine in acetonitrile followed by aqueous 30% ammonium hydroxide or a 50/50 mixture of aqueous 30% ammonium hydroxide and 40% methyl ammonium hydroxide. The deprotected aptamers are then desalted prior to subsequent use.

To link the aptamer domains, the anti-VEGF aptamer bearing a 5' prime amine is first incubated with a 1.5-5-fold molar excess of the heterobifunctional PEG linker, SM(PEG)24, in 0.1M sodium bicarbonate buffer at pH 8.5. Following incubation, typically 2-20 hr, the resultant maleimide activated aptamer conjugate is purified by size exclusion chromatography, anion exchange chromatography, or ion paired reverse phase chromatography.

Subsequently the, anti-IL8 aptamer bearing a 5' C6SS thiol modifier is reduced following treatment with 100 mM TCEP in 0.1M TEAA by heating at 70 C for 5 minutes. The reduced aptamer is then desalted to remove free thiol and reducing agents and incubated 1:1 with the maleimide activated anti-VEGF aptamer conjugate in PBS, pH 7.4. Following incubation, typically 2-20 hr, the resultant aptamer conjugate is purified by size exclusion chromatography, anion exchange chromatography, or ion paired reverse phase chromatography.

Finally, PEGylation of the 3' end of the bispecific aptamer is achieved by combining the bispecific aptamer conjugate with a 1.5-5-fold molar excess of NHS activated SUNBRIGHT® GL2-400GS2 in 0.1M sodium bicarbonate buffer at pH 8.5. Following incubation, typically 2-20 hr, the PEGylated bispecific aptamer is then purified by either anion exchange chromatography or ion paired reverse phase chromatography. The PEGylated bispecific aptamer is subsequently desalted prior to future use.

A number of variations to this approach can be utilized to achieve the same or similar end product. Such approaches might make use of different buffers, solutions or reagents that are well known in the art. Additionally, the order of conjugation and/or the need for or the methods of purification can be varied and/or substituted with a variety of alternatives. Similarly, the orientation of the aptamer (5' and 3') as well as the identity and location of the chemical groups (5' and 3') employed for conjugation described here (amine and thiol) could be varied or substituted for any number of different linker chemistries (amine, thiol, alkyne, azide, etc.) to achieve a similar end product. This approach could be applied to any combination of aptamers, in particular those in Table 27.

Example 5: Bispecific Aptamers Targeting VEGF and IL8 by Domain Hybridization

An aptamer domain targeting VEGF and an aptamer domain targeting IL8 can be synthesized using solid phase chemical synthesis separately and following deprotection and/or purification linked by hybridization (FIGS. 8-9).

The anti-VEGF aptamer (aptamer 285 (SEQ ID NO: 1); CXACZCCGCGCGGAGGGXUUU-CAUAAUCCCGUUUXUCX, where A, C and U are 2'OMe, G is 2'F G, X is 2'OMe G and Z is the 3-carbon non-nucleotidyl spacer is 1,3-propanediol) is linked to the 5' end of a short hybridization domain, S18-CUCUCUXA (where A, C and U are 2'OMe, X is 2'OMe G and S18 is a hexaethylene glycol non-nucleotidyl spacer) yielding a final sequence, CXACZCCGCGCGGAGGGXUUU-CAUAAUCCCGUUUXUCX-S18-CUCUCUXA (SEQ ID NO: 1) where A, C and U are 2'OMe, G is 2'F G, X is 2'OMe G, Z is the 3-carbon non-nucleotidyl spacer is 1,3-propanediol and S18 is a hexaethylene glycol non-nucleotidyl spacer.

The anti-IL8 aptamer (aptamer 269 (SEQ ID NO: 48); XXCXACXXUAXAUUAUGGGCAGU-GUGACCXCXCC, where A, C and U are 2'OMe, G is 2'F G, X is 2'OMe G) is similarly linked to a short complementary hybridization domain, S18-UCAXAXAX (where A, C and U are 2'OMe, X is 2'OMe G and S18 is a hexaeyhtleneglycol non-nucleotidyl spacer) yielding a final sequence XXCXACXXUAXAUUAUGGGCAGU-GUGACCXCXCC-S18-UCAXAXAX (SEQ ID NO: 48), where A, C and U are 2'OMe, G is 2'F G, X is 2'OMe G and S18 is a hexaethylene glycol non-nucleotidyl spacer.

Chemical synthesis is preformed using a combination of commercially available 2'-fluoro-G and 2'-O-methyl (2'OMe) A/C/U/G modified phosphoramidites and a hexaethylene glycol phosphoramidite on a 3' inverted deoxythymidine CPG support. To the 5' end of the anti-IL8 aptamer construct is added a 5' C6 amino modifier to facilitate PEG conjugation.

Following synthesis, the individual aptamers are deprotected using the appropriate solvents and reagents capable of removing the phosphate protecting groups, removing the base protecting groups and cleaving the molecule from the support. For example, the aptamers could be treated with diethylamine in acetonitrile followed by aqueous 30% ammonium hydroxide or a 50/50 mixture of aqueous 30% ammonium hydroxide and 40% methyl ammonium hydroxide. The deprotected aptamers are then purified.

To link the aptamer domains, the anti-VEGF and anti-IL8 molecules bearing their hybridization tails are incubated in PBS at a ratio of 1:1 and subsequently heated to 70 C for 5 minutes after which they are allowed to cool to room temperature. Following this annealing step, the bispecific aptamer is buffer exchanged into 0.1M borate buffer, pH 8.5 and incubated with a 1.5-5 fold molar excess of NHS activated SUNBRIGHT® GL2-400GS2. Following incubation, typically 2-20 hr, the PEGylated bispecific aptamer is then purified by either anion exchange chromatography or ion paired reverse phase chromatography. The PEGylated bispecific aptamer is subsequently desalted prior to future use.

A number of variations to this approach can be utilized to achieve the same or similar end product. Such approaches might make use of differ buffers, solutions or reagents that are well known in the art. Additionally, the order of hybridization, PEG conjugation and/or the need for or the methods of purification can be varied and substituted with a variety of alternatives. Similarly, the orientation of the aptamers as well as the identity of the chemical groups employed for conjugation described here (amine and thiol) could be substituted for any number of different linker chemistries (amine, thiol, alkyne, azide, etc.) to achieve a similar end product. Additionally, the length of the linker and the identity of the linker separating the aptamer and the hybridization domain can be varied. For example, the hexaethylene glycol non-nucleotidyl spacer, S18, could be replaced with a shorter 1,3-propanediol non-nucleotidyl spacer. Alternately, the spacer could be composed of nucleotides, for example, by the insertion of a string of 2'OMe uridine residues (e.g. UUUUU; where U is 2'OMe) such that the distance of the aptamer domains can be varied by changing the number of nucleotides.

The use of a linker composed of nucleotides would allow for individual aptamer domains to be generated by enzymatic synthesis, provided that the selected aptamer domains did not contain any other non-nucleotide linkers and were comprised of nucleotides that are amenable to in vitro transcription. For example, the anti-VEGF aptamer, aptamer 26 (SEQ ID NO: 2), (AGGCCGCCUCCGCGCGGAGGG-GUUUCAUUAUCCCGUUUGGCGGCUU) could be linked to the 5' end of a short complementary hybridization domain, UUUUUUCAGAGAG (SEQ ID NO: 444) (where A, C and U are 2'OMe, G is 2'F G and the linker domain is underlined) yielding a final sequence AGGCCGC-CUCCGCGCGGAGGGGUUU-CAUUAUCCCGUUUGGCGGCUUUUUUUUCAGAGAG (SEQ ID NO: 445). The sequence could subsequently be encoded in a double stranded DNA immediately adjacent to the 3' end of a dsDNA phage polymerase promoter and transcribed into modified RNA using the appropriate mutant phage polymerase and nucleotide mixture (e.g. 2'F GTP, 2'OMe ATP, 2'OMe CTP, 2'OMe UTP. Following purification, the modified aptamer could be combined by hybridization with a second aptamer domain (generated by either chemical or enzymatic synthesis) bearing the appropriate complementary hybridization domain. The approach could be applied to any combination of aptamers, in particular those in Table 27.

Example 6: Determination of Apparent Binding Constants by Competition TR-FRET

This assay is used to compare IL8 binding affinity of the IL8 component of the bispecific composition with the binding affinity of a monospecific IL8 aptamer with a known binding constant. This assay uses labeled protein (commercially available His-tagged IL-8) and a labeled control compound (an anti-IL8 aptamer) known to bind this protein target and generate a TR-FRET signal. The labeled control compound will be mixed with increasing concentrations of non-labeled test bispecific compounds that will compete for binding. Assays will be performed over a range of 5-7 concentrations to determine the $IC_{50}$. In short, 5 nM His-tagged IL8 is mixed with 2.5 nM anti-His-Eu conjugate and incubated for 15 minutes. A monospecific anti-IL8 aptamer is synthesized and labeled with ALEXA FLUOR® 647. A mixture of 30 nM of the labeled monospecific aptamer and increasing concentrations of the bispecific compounds ranging from 0 to 3 uM is then added and incubated for 2 hr. plate is read on a Biotek CYTATION™ 5 plate reader. Samples are excited at 330 nm and fluorescent values are collected at 665 nm. Following incubation, the loss of fluorescent signal observed from increasing concentration of the bispecific aptamer will be used to determine the $IC_{50}$ values for each bispecific construct and compared to a control titration using the unlabeled monospecific anti-IL8 aptamer.

A similar assay format can be used to compare VEGF binding affinity of the VEGF component of the bispecific composition with the binding affinity of a monospecific VEGF aptamer with a known binding constant.

This assay uses glycan biotinylated-VEGF165 (VEGF165, biotinylated using aminooxy-biotin following mild oxidation with sodium periodate) and a labeled control compound (an anti-VEGF aptamer) known to bind this protein target and generate a TR-FRET signal. The labeled control compound will be mixed with increasing concentrations of non-labeled test bispecific compounds that will compete for binding. Assays will be performed over a range of 5-7 concentrations to determine the $IC_{50}$. In short, 1 nM biotinylated VEGF165 is mixed with 0.5 nM steptavidin-Eu conjugate and incubated for 15 minutes. A monospecific anti-VEGF aptamer is synthesized and labeled with ALEXA FLUOR® 647. A mixture of 5 nM of the labeled monospecific aptamer and increasing concentrations of the bispecific compounds ranging from 0 to 1 uM is then added and incubated for 2 hr. The plate is read on a Biotek CYTATION™ 5 plate reader. Samples are excited at 330 nm and fluorescent values are collected at 665 nm. Following incubation, the loss of fluorescent signal observed from increasing concentration of the bispecific aptamer will be used to determine the $IC_{50}$ values for each bispecific construct and compared to a control titration using the unlabeled monospecific anti-VEGF aptamer.

Example 7: Determination of Anti-VEGF Activity by Competition ELISA

This assay is used to evaluate inhibitory activity of the anti-VEGF portion of the bispecific aptamer constructs. They are compared with the inhibitory properties of a monospecific anti-VEGF aptamer with known activity. The assay uses an ELISA to look directly at the ability to interfere with the VEGF-A:KDR interaction.

Briefly, 10 nM KDR-Fc fusion protein (R&D Systems) in PBS is immobilized on a 96 well plate (Nunc Maxisob) by incubation overnight at 4° C. Following immobilization, the solution is removed, and the plate is blocked with 200 μL of blocking buffer (20 mg/mL BSA in PBST buffer) at room temperature for 2 hours after which the plate is washed again 3× with 200 uL PBST. A mixture containing 300 pM of glycan biotinylated-$VEGF_{165}$ preincubated with increasing concentrations of test compound ranging from 0 to 50 nM, is then added to each well. Following an additional 2 hr incubation the plates are washed 3× with PBST and then incubated with 50 μL of 1:5000 diluted streptavidin-HRP (horse radish peroxidase) in PBST for 1 hr at room temperature. The amount of biotinylated-VEGF165 bound to the plate, and thus degree of inhibition, is determined using 100 uL TMB ultra followed by 100 uL 2N sulfuric acid and the percent inhibition for each construct was calculated by the following formula:

% inhibition=1−(sample−low control)/(high control−low control)*100

The values are fit by using a four-parameter non-linear fit in GraphPad Prism Version 7.0.

Example 8: Characterization of Inhibition of VEGF-A Signal Transduction by KDR Phosphorylation AlphaLisa®

When the receptor binding domain (RBD) of VEGF-A binds to its receptor KDR, the receptor dimerizes leading to trans-autophosphorylation and activation of VEGF-A signaling. To determine if bispecific aptamers can inhibit VEGF-A activity on cells, bispecific aptamers can be tested for the ability to inhibit KDR phosphorylation induced by either VEGF-$A_{165}$ or VEGF-$A_{121}$ and compared to the activity of a monospecific anti-VEGF with known activity, or to anti-VEGF-A antibody.

Briefly, HEK293 cells engineered to stably overexpress KDR are plated overnight on collagen coated 96 well plates at 50 k cells/well. Aptamers in SB1+(40 mM HEPES, pH 7.5, 125 mM NaCl, 5 mM KCl, 1 mM MgCl2) are heated to 90° C. for 3 minutes and allowed to cool to room temperature for a minimum of 10 minutes. VEGF-$A_{121}$ (Biolegend) and VEGF-$A_{165}$ (R&D Systems) are prepared at 12.5 nM in DMEM+0.8% FBS, a 20× stock for the reaction. 15 μL of VEGF-A is added to 15 μL titrated aptamer in a polypropylene plate and diluted to 300 μL with TS buffer (10 mM Tris pH 7.5; 100 mM NaCl; 5.7 mM KCl; 1 mM $MgCl_2$; 1 mM $CaCl_2$). The aptamer/VEGF-A mixture is incubated at 37° C. for 30 minutes, after which 100 μL is added to the cells for 5 minutes at 37° C. in 5% $CO_2$. The treatment is aspirated from cells, and the cells lysed with 100 μL cold lysis buffer [20 mM Tris-HCl, pH 7.5, 150 mM NaCl, 1 mM EDTA, 1% Triton X-100, 0.5 mM sodium orthovanadate (freshly prepared), 1 mM PMSF (freshly prepared), lx protease inhibitor cocktail (freshly prepared)] on ice for 10 minutes. The plates are centrifuged at 4000×g for 10 minutes before transferring the cell lysis to the AlphaLISA® assay plate for analysis.

To perform the AlphaLISA® assay, 10 μL of cell lysis is transferred to a white low volume 384 well Optiplate (Perkin Elmer). A mixture of the following components is made in order of which they are listed: 1.25 nM anti-hVEGFR2 polyclonal goat IgG antibody (R&D Systems), 10 μg/ml AlphaLISA® anti-goat IgG acceptor beads (Perkin Elmer), 1.25 nM P-tyrosine biotinylated mouse mAb (Cell Signaling Technology), and 10 μg/ml AlphaScreen® streptavidin donor beads (Perkin Elmer). 10 μL of this reagent mixture is added to the assay plate that contains 10 μL of cell lysate. The assay plate is sealed and incubated in the dark for approximately 2 hours, and is then read on a Biotek CYTATION™ 5 plate reader using the Alpha 384 well optical cube. Percent inhibition is calculated by subtracting TS buffer background from each value and normalizing to VEGF-A only controls. The values can be fit by using a four-parameter non-linear fit in GraphPad Prism Version 7.0.

Example 9: Inhibition of IL8-Mediated Neutrophil Migration

This assay is used to evaluate the ability of the anti-IL8 portion of the bispecific aptamers to block the interaction between IL8 and its cognate receptors, CXCR1/CXCR2 thereby blocking the recruitment of neutrophils, induced by IL8. The assay makes use of a Boyden chamber in which neutrophils are placed in the top chamber and IL8, along with an increasing concentration of bispecific aptamer are added to the bottom chamber. A monospecific anti-IL8 aptamer with known activity is used as a comparator.

Briefly, freshly isolated primary human neutrophils are isolated from fresh whole human blood using Polymorphprep™ (AXIS Shield) and then resuspended in assay buffer (RPMI+0.1% Human Serum Albumin) at 10^6 cells/mL. 5 μm Transwell inserts (Corning) are activated with 200 μL assay buffer in the plate and 100 μL of assay buffer in the top chamber of the transwell at 37° C. 3 nM IL8 and increasing concentrations of bispecific aptamers or (0-1 pM) or monospecifc aptamer control are incubated for 1 hour and then 200 μL of this aptamer/IL8 mix is added to each well. Neutrophils in 100 μL of assay buffer are added to the top chamber of the transwell. After 45 minutes at 37° C., 100 μL from each well is transferred to a white 96-well plate with 50 μL of lysis buffer. The number of cells that migrate from the top chamber to the bottom well is quantified using the ATPLITE® Luminescence Assay System (Perkin Elmer). $IC_{50}$ values can be determined by a best fit of the data using GraphPad Prism Version 7.0.

Example 10: Inhibition of Endothelial Permeability

This assay assesses the ability of bispecific aptamers to inhibit the effects of VEGF and IL8 on endothelial cell permeability. The assay makes use of a Boyden chamber in which cells (HUVEC or RMEC) are placed in the top chamber and allowed to form a confluent monolayer as determined by restricted dye leakage, horseradish peroxidase (HRP) leakage or transendothelial electrical resistance (TEER). To the transwell is added VEGF, IL8 or a mixture of these proteins. These proteins increase endothelial permeability which can be measured by diffusion of HRP which can be added to the insert. A model for the experiment is described in (Human Reproduction, Volume 25, Issue 3, March 2010, Pages 757-767).

An initial titration experiment is performed using VEGF and IL8 to identify minimal protein concentrations required to induce permeability following a 1 hr incubation as determined by leakage of HRP across the cell layer. The inhibitory effects of our test compounds can then be assessed in this system using the concentrations specified from these control titrations. A monospecific anti-IL8 aptamer, or anti-VEGF aptamer with known activity is used as a comparator.

In short, a mixture of IL8 and VEGF at concentrations sufficient to induce permeability following a 1 hr incubation is incubated with increasing concentrations of bispecific aptamer, monospecific anti-IL8 aptamer, or anti-VEGF aptamers at 5 to 8 concentrations ranging from 0 to 1 pM. The mixture is preincubated for 1 hr at 37° C. and then added to a confluent monolayer of cells along with HRP (Type VI-A, 44 kDa; Sigma-Aldrich) at a concentration of 0.126 pM. After an additional 1 hr incubation the medium in the lower well is collected and assayed for HRP enzymatic activity using a photometric guaiacol substrate assay (Sigma-Aldrich). The detection reaction is allowed to proceed for 15 min at room temperature, and absorbance is measured at 450 nm.

Example 11: Bispecific Composition in a Rabbit Model of Chronic Retinal Neovascularization Here we describe in detail a model of sustained retinal neovascularization (RNV) and leakage, the DL-a-aminoadipic acid (AAA) model in rabbits. This is a model that measures a compounds ability to inhibit pathologic leakage. In brief, rabbits receive a single IVT injection of AAA, with weekly follow-up fundus photography, fluorescein angiography (FA), and optical coherence tomography (OCT). After 10 weeks, they receive a single IVT bispecific composition or control injection. RNV leakage is quantified from FA by image analysis with Photoshop. Some eyes are collected for histologic analysis.

This model mimics a chronic human disease in its stability and persistence, and the antileak action of the bispecific composition should be fully reversible with a dose-dependent duration. Therefore, this large eye model is uniquely suitable for investigations into the efficacy and duration of action of novel formulations and pharmacotherapies for retinal vascular diseases, and for studying the underlying pathobiology of retinal angiogenesis.

Male New Zealand White (NZW) rabbits with a mean age of 8 to 10 weeks and weight range of 2 to 2.5 kg are utilized for the model. All animal experiments will conform with the Association for Research in Vision and Ophthalmology (ARVO) Statement for the Use of Animals in Ophthalmic and Vision Research.

To prepare a AAA solution, 120 mg amount of AAA is dissolved in 1 mL hydrochloric acid [1 N]. The AAA stock solution is then diluted to an 80 mM solution using 0.9% sterile normal saline solution which is followed by adjusting the pH of the solution to 7.4. The final solution is then passed through a disposable Millex-GP syringe filter unit with a pore size of 0.22 lm to remove any potential particulates. Solutions should be made immediately before use and all solutions should remain at room temperature until time of injection.

Initial baseline in-life ophthalmic evaluations are performed before induction of RNV. Rabbits are anesthetized with ketamine (35 mg/kg, intramuscular) and Xylazine (5 mg/kg, intramuscular). Heart rate, respiratory rate, mucus membrane color, body temperature, and pulse oximetry are monitored every 15 minutes for the entire duration of anesthesia in each animal. Corneas are anesthetized further using a 0.5% ophthalmic solution of proparacaine hydrochloride. Pupils are dilated using a 1% ophthalmic solution of tropicamide. An additional drop of a GenTeal lubricating eye gel is applied to the eye to help with corneal hydration. A juvenile ophthalmic speculum then is used to open the eyelids for intraocular imaging.

Ophthalmic evaluations include a photograph of the eye using a Canon PowerShot digital camera for assessment of gross inflammation and an intra-ocular pressure (IOP) measurement using a Tono-Pen is taken before pupil dilation. Approximately 5 minutes after pupil dilation, fundus examination using a WelchAllyn PanOptic Ophthalmoscope, Red-free Imaging using a Spectralis Heidelberg retinal angiography platform HRAþ OCT system, early (0-3 minutes) and late (10-13 minutes) phase fluorescein angiography (FA) using the Spectralis imaging system, and multiple 61-scan P-Pole optical coherence tomography (OCT) imaging using the Spectralis system are performed for each eye.

Following initial baseline in-life ophthalmic evaluations, male NZW rabbits receive an 80 μL IVT injection of an 80 mM AAA solution (described earlier) with an injection site at 10 o'clock for the right eye (OD) and 2 o'clock for the left eye (OS). After 10 minutes, a second IOP measurement is obtained to assess acute pressure changes due to injection volume. An additional ophthalmoscope observation is used to identify any potential damage during injection. A 0.5% Erythromycin Ophthalmic Ointment is applied to the eye immediately after observation.

Animals receive follow-up examinations, similar to what is performed at baseline, between 0 and 65 weeks after AAA injection, which are used to assess disease progression. Any eyes with severe retinal detachment, either procedure-related or due to serious retinal damage, or absence of vascular leakage (10%-20%) are excluded from the studies.

To quantify disease progression at baseline prior to treatment, NZW rabbits receive two IVT injections of BrdU at 10 mcg/50 mcl, on days 28 and 32, after DL-AAA. At week 10, rabbits are euthanized and perfused with fluorescein ConA diluted in 1% paraformaldehyde and eyecups are fixed further overnight in 1% PFA at 48 C. Following fixation, retinas are dissected, permeabilized, and blocked overnight at 37° C. in PBS containing 0.5% BSA, 0.1% Triton X-100, and normal goat serum. The following day, retinas are washed in PBS containing Triton X-100 and are incubated in 2N HCl for 1 hour at room temperature, washed again in PBS, and incubated overnight at 37° C. in mouse anti-BrdU. Following incubation with primary antibody, retinas are washed again and incubated with goat anti-mouse Alexa 647 for 3 hours at 37° C. and mounted with ProLong antifade.

For treatment and control animals, on week 10, after AAA administration, when retinal neovascular leakage is stabilized, a therapeutic baseline ophthalmic examination is performed similar to examinations described previously. Rabbits are divided into treatment or control groups, and the anesthetized animals are prepared for IVT treatment immediately following examination. An intravitreal (IVT) bispecific composition is given at a range of doses. Control groups receive either buffer or human Fc. All IVT injections will have a volume of 50 μL regardless of the dose of the bispecific composition. A second IOP measurement is taken 10 minutes after the treatment injections. A 0.5% Erythromycin Ophthalmic Ointment is applied to the eye immediately after the second IOP measurement. In a separate cohort, on week 10 after AAA induction, repeat IVT doses of the bispecific composition can be given with the subsequent dose given following a full recurrence of pathologic leakage.

Further follow-up ophthalmic examinations are performed at weeks 1 through 20 after bispecific composition injections. Red-free images and early-phase FA images are exported from the Heidelberg software and imported to Adobe Photoshop CC. Multiple images per eye are overlaid and merged into a mosaic of the fundus. For FA images, leakage area is quantified by tracing over the fluorescein cloud in the vitreous using a paintbrush tool and calculating the number of pixels covered. Leakage area is standardized weekly using the area of the optic nerve head. Data is recorded as the percent leakage area when compared to baseline leakage area before any treatment with the bispecific composition.

At each time point, percent leakage area is compared among treatments using 1-factor ANOVAs with a Tukey's multiple comparison test. All analyses are performed using GraphPad Prism. Data are shown as mean values+/−SEM, unless stated otherwise. A P value of less than 0.05 is considered statistically significant.

Vitreous is isolated and centrifuged for 10 minutes at 10,000 g from normal and DL-AAA treated eyes with already established disease. The upper phase is collected, aliquoted, and stored at −80° C. until VEGF levels are assessed. VEGF levels are measured using a Milliplex Assay from Millipore following manufacturer's instructions.

Eyes are enucleated and placed in either 10% formalin or Davidson's fixative for 48 hours. Following fixation, right eyes are dissected and placed in 70% ethanol until processed for paraffin embedding. Serial sections from each eye are then stained with hematoxylin and eosin. Left eyes processed for immunostaining are embedded in OCT Tissue-Tek, sectioned, and stored at −80° C. Before washing the OCT with PBS, the eyes are placed in a 50% to 60° C. oven for 15 minutes. Following removal of OCT, the tissue is permeabilized with 0.1% Triton X-100 (Thermo Fisher Scientific) for 15 minutes and blocked with PBS+1% BSA+0.1% TritonX+5% normal goat serum for 1 hour. Mouse anti-B-Tubulin Alexa488 is added at 1:200 in blocking buffer and sections are incubated at 48° C. overnight. The following day, sections are washed with PBS and mounted with ProLong Gold Antifade. Images are acquired in a Nikon 80i Eclipse Microscope.

Example 12: Evaluate Efficacy of Bispecific Composition Using a Pig Laser CNV Model Due to the similar eye size and retinal anatomy to humans, pigs have become the favored model animal for assessing test drug efficacy in posterior segment proliferative disease. While rabbits are commonly used in many ophthalmic studies, their retinal architecture differs significantly from those of humans, making the use of pigs an excellent alternative. To this end we will assess efficacy in a laser CVN model in pigs.

In more detail, on day 0, a topical mydriatic (1.0% tropicamide HCL) will be applied at least 15 minutes prior to the laser procedure to each animal. The pigs will receive 0.01-0.03 mg/kg buprenorphine intramuscularly (IM) and will be anesthetized with ketamine/dexmedetomidine IM (1 mg and 0.015 mg per kg body weight, I.M., respectively). A wire eyelid speculum is placed, and the cornea kept moistened using topical eyewash. An 810 nm diode laser delivered through an indirect ophthalmoscope will be used to create approximately 6 single laser spots between retinal veins. While sedated, pigs will also be injected with test compounds. The conjunctiva will be gently grasped with colibri forceps, and the injection (27-30 G needle) made 2-3 mm posterior to the superior limbus (through the pars plana) will be done with the needle directly slightly posteriorly to avoid contact with the lens. The injection will be made, and the needle slowly withdrawn. Following the injection procedure, 1 drop of antibiotic ophthalmic solution will be applied topically to the ocular surface.

Mydriasis for ocular examination will be done using topical 1% tropicamide HCL (one drop in each eye 15 minutes prior to examination). Complete ocular examination (modified Hackett and McDonald) using a slit lamp biomicroscope and indirect ophthalmoscope will be used to evaluate ocular surface morphology, anterior segment and posterior segment inflammation, cataract formation, and retinal changes will be conducted on days 7 and 14 post treatment.

Fluorescein angiography (FA) will be conducted on days 7 and 14 post treatment on anesthetized animals [ketamine/dexmedetomidine (IM)]. Mydriasis for FA will be done using topical 1% Tropicamide HCL (one drop in each eye 15 minutes prior to examination). Full FA will be performed 1-3 minutes after intravenous sodium fluorescein injection (12 mg kg-1). A trained reader will analyze the masked images obtained. Area of maximal fluorescein leakage will be measured using Image J for each lesion.

Terminal collections (aqueous humor, vitreous humor, retina and plasma) will be performed at the end of the experiment to provide material for PK/PD analyses.

Example 13 Evaluate Efficacy of Bispecific Composition in Non-Human Primates Using the DL-α-Aminoadipic Acid (dlAAA) Chronic Vascular Leak Model Testing in non-human primate disease models is the gold standard for demonstrating efficacy, most strongly supporting successful translation to humans. To this end, we will assess the efficacy of a bispecific composition in a DL-α-aminoadipic acid (dlAAA) chronic vascular leak model in green monkeys (Chlorocebus sabaeus) or cynomolgous monkeys.

On day 0 all enrolled monkeys will receive IVT injections of 5 mg DLAAA in both eyes. DLAAA is dissolved in 1M hydrochloric acid to generate a 100 mg/mL stock solution, which is then diluted with phosphate buffered saline, pH adjusted to 7.4 and is filtered through a 0.2-micron filter. Aliquots of DLAAA dose solutions (25 mg/mL) are prepared before the day of dosing and stored at −80° C. At the time of IVT dosing the required amount of frozen DLAAA solution aliquots is removed from the freezer and is thawed to room temperature prior to loading into dosing syringes. All aliquots are prepared from a single batch of DLAAA. Prior to IVT dosing, topical 1% atropine is applied to each eye to achieve full pupil dilation. The ocular surface is anesthetized with 1-2 drops of 0.5% proparacaine and is prepared aseptically with 5% Betadine followed by sterile 0.9% saline. A vitreous tap is performed with a 1 mL syringe attached to a 27-gauge needle to remove 100 μL of vitreous humor, which will then be stored at −80° C. Vitreous taps are performed prior to DLAAA dosing to limit intraocular pressure elevation. DLAAA solution (5 mg/200 μL) is delivered to the mid-vitreous 3 mm posterior to the limbus in the inferior temporal quadrant using 0.3 cc insulin syringes with a 31 G 0.5-inch needle. Injections are immediately followed by topical administration of triple antibiotic ointment and 1% atropine ointment.

Following ophthalmic examinations at weeks 8 or 9 following DLAAA treatment, fluorescein angiography (FA) images are graded by a masked assessor to evaluate severity of DLAAA-induced retinal neovascular leakage, referencing a standard leakage scoring scale. Animals are stratified based on cumulative scores in both eyes and assigned to treatment groups to achieve balanced severity of baseline DLAAA-induced pathology. FA imaging is repeated at week 10 prior to treatments to confirm animal assignments and capture baseline FA images. Prior to bispecific IVT dosing the ocular surface is anesthetized with 1-2 drops of 0.5% proparacaine and prepared aseptically with 5% Betadine followed by sterile 0.9% saline. Bispecific composition treatments are delivered IVT to monkeys using sterile 0.3 mL insulin syringes pre-fitted with 31 G 5/16" needles. The needle is placed 2 mm posterior to the limbus in the inferior temporal quadrant, targeting the central vitreous. Eyes will receive a single IVT injection of either vehicle (0.9% saline, 50 μL) or aflibercept (35 μL of 40 mg/mL solution; Eylea®, Regeneron, Tarrytown, NY) or the bispecific composition. Dose levels of test agents are selected based on relative vitreous volume of African Green monkeys (approximately 2.7 mL) and comparative human vitreous volume of 4.4 mL. All contralateral eyes will receive identical treatment. Injections are followed by topical administration of neomycin/polymyxin B sulfates/bacitracin antibiotic ointment. Dosing is conducted over 2 days and follow-up examination schedules will be maintained for the duration of the study.

Eyes are examined by slit lamp biomicroscopy at baseline, biweekly after DLAAA administration and weekly after intervention until study terminus to confirm integrity of the ocular surface, general ocular health, broad ocular response to DLAAA administration and normal response to mydriatics and 1% cyclopentolate HCl. Ophthalmic findings are graded using a modified version of the Hackett-McDonald scoring system.

Bilateral color fundus images of the retina will be obtained at baseline, biweekly after DLAAA administration and weekly after intervention until study terminus with 500 field of view centered on the fovea using a Topcon TRC-50EX retinal camera with Canon 6D digital imaging hardware and New Vision Fundus Image Analysis System software.

Fluorescence angiograms (FA) are acquired using either a Topcon TRC-50EX retinal camera or a Heidelberg HRA+ OCT with high resolution acquisition at fixed gain and flash intensity following intravenous injection of 0.1 mL/kg of 10% sodium fluorescein. Images will be collected up to 6 minutes after fluorescein administration. The retinal area exhibiting vascular leakage in the full series of angiograms will be assessed and scored using a graded scoring system, and the total fluorescence intensity within the leaking area in the 1-minute raw angiograms will be quantified using a semi-automated multi ROI tool in ImageJ (week 10 to study terminus).

Following treatment, animals will be imaged weekly. Terminal collections (aqueous humor, vitreous humor, retina and plasma) will be performed at the end of week 20 to provide material for PK/PD analyses.

Example 14: Evaluate Efficacy of Bispecific Composition in Non-Human Primates (NHP) Using a Laser CNV Model The efficacy of bispecific aptamers can also be evaluated in NHP using a laser CNV model. Briefly, animals are anesthetized for all procedures with intramuscular injection of 5:1 ketamine:xylazine mix (0.2 mL/kg of 100 mg/mL ketamine and 20 mg/mL xylazine). On day 0, laser photocoagulation will be conducted in all animals. Six laser spots will be symmetrically placed within the perimacular region, approximately 1 to 1.5 optic disc distance from the fovea in each eye by an ophthalmologist employing an Iridex Oculight TX 532 nm laser with a laser duration of 100 ms, spot size 50 μm, power 750 mW. Color fundus photography will be performed immediately after the laser treatment to document the laser lesions. Any spots demonstrating severe retinal/subretinal hemorrhage immediately post-laser and not resolving by the time of follow-up examinations will be excluded from analyses. If hemorrhage occurs encompassing all target lesion areas within the central retina, then the animal will be substituted for with another screened monkey, up to four monkeys across all treatment groups, taking measures to assure balanced assignment to treatment. To accommodate the time necessary for follow-up imaging, monkeys may be divided into two cohorts for laser-induction of CNV, dosing and imaging on successive days, with animals from each treatment group distributed evenly across each cohort.

All animals will undergo OCT imaging at Day 9 post-laser. CNV complex area for each laser lesion will be measured from the OCT images and a mean size of lesions in each animal will be calculated. Animals will then be assigned to treatment groups based on the mean per animal lesion grade with groups additionally balanced by sex (1:1 per treatment arm) to achieve approximately equivalent mean lesion grade across treatment groups.

Test article delivery (IVT injection) will be performed on day 11 for all groups in both eyes (OU), according to the treatment assignments. An eye speculum will be placed in the eye to facilitate injections followed by a drop of proparacaine hydrochloride 0.5% and then 5% Betadine solution, and a rinse with sterile saline. IVT injections to the central vitreous will be administered using a 31-gauge 0.375-inch needle inserted inferotemporally at the level of the ora serrata ~2.5 mm posterior to the limbus. Following both IVT injections, a topical triple antibiotic neomycin, polymyxin, bacitracin ophthalmic ointment (or equivalent) will be administered.

At designated time points Intraocular pressure (IOP) measurements will be collected using a TonoVet (iCare, Finland) tonometer set to the dog (d) calibration setting. The animal will be placed in a supine position for the measurement. Three measures will be taken from each eye at each time point and the mean IOP defined.

At designated time points intraocular inflammation will be examined with slit lamp biomicroscopy. Scoring will be applied to qualitative clinical ophthalmic findings using a nonhuman primate ophthalmic exam scoring system with a summary clinical score derived from exam components.

At designated time points bilateral color fundus images will be captured centered on the fovea using a Topcon TRC-50EX retinal camera with Canon 6D digital imaging hardware and New Vision Fundus Image Analysis System software. Fluorescein angiography (FA) will be performed with intravenous administration of 0.1 mL/kg of 10% sodium fluorescein and images will be taken continuously from 30 seconds to 6 minutes. OD FA precedes OS angiography by greater than 2 hours to allow washout of the fluorescein between angiogram image series. Fluorescein leakage in angiograms of CNV lesions will be graded assessing composites generated after uniform adjustment of image intensity. Image fluorescence densitometry analysis of late-stage raw angiograms will also be performed using ImageJ software.

At designated time points OCT will be performed using a Heidelberg Spectralis OCT Plus with eye tracking and HEYEX image capture and analysis software. An overall volume scan of encompassing the posterior retina will be performed. At baseline examination, the retinal cross-sectional display image will be obtained. At post-laser examinations, six star-shaped scans per eye, centered on each lesion, will be performed, as well as an overall volume scan of the entire macula encompassing the six laser spots at a dense scan interval. The principal axis of maximal CNV complex formation within each star-shaped scan at each laser lesion will be defined and the CNV complex area measured using the freehand tool within ImageJ to delineate the CNV complex boundary and calculate maximum complex area in square microns (um2).

Terminal collections (aqueous humor, vitreous humor, retina and plasma) will be performed at the termination of the study to provide material for PK/PD analyses.

SEQUENCE LISTING (447 sequences)

SEQ ID NO: 1 - RNA, 33 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
ccgcgcggagggguuucauaaucccguuugucg

SEQ ID NO: 2 - RNA, 46 nt, Artificial Sequence
  Aptamer
  modified_base (1)..(1): 2'O-Methyl Adenosine
  modified_base (2)..(3): 2' Fluoro Guanosine
  modified_base (4)..(5): 2'O-Methyl Cytosine
  modified_base (6)..(6): 2' Fluoro Guanosine
  modified_base (7)..(8): 2'O-Methyl Cytosine
  modified_base (9)..(9): um
  modified_base (10)..(11): 2'O-Methyl Cytosine
  modified_base (12)..(12): 2' Fluoro Guanosine
  modified_base (13)..(13): 2'O-Methyl Cytosine
  modified_base (14)..(14): 2' Fluoro Guanosine
  modified_base (15)..(15): 2'O-Methyl Cytosine
  modified_base (16)..(17): 2' Fluoro Guanosine
  modified_base (18)..(18): 2'O-Methyl Adenosine
  modified_base (19)..(22): 2' Fluoro Guanosine
  modified_base (23)..(25): um
  modified_base (26)..(26): 2'O-Methyl Cytosine
  modified_base (27)..(27): 2'O-Methyl Adenosine
  modified_base (28)..(29): um
  modified_base (30)..(30): 2'O-Methyl Adenosine
  modified_base (31)..(31): um
  modified_base (32)..(34): 2'O-Methyl Cytosine
  modified_base (35)..(35): 2' Fluoro Guanosine
  modified_base (36)..(38): um
  modified_base (39)..(40): 2' Fluoro Guanosine
  modified_base (41)..(41): 2'O-Methyl Cytosine
  modified_base (42)..(43): 2' Fluoro Guanosine
  modified_base (44)..(44): 2'O-Methyl Cytosine
  modified_base (45)..(46): um
aggccgccuccgcgcggagggguuucauuaucccguuuggcggcuu

SEQ ID NO: 3 - RNA, 38 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(19): um
  modified_base (20)..(21): 2' Fluoro Guanosine
  modified_base (22)..(22): 2'O-Methyl Adenosine
  modified_base (23)..(24): 2' Fluoro Guanosine
  modified_base (25)..(26): um
  modified_base (27)..(27): 2'O-Methyl Adenosine
  modified_base (28)..(30): 2'O-Methyl Cytosine
  modified_base (31)..(31): 2' Fluoro Guanosine
  modified_base (32)..(34): um
  modified_base (35)..(35): 2' Fluoro Guanosine
  modified_base (36)..(36): um
  modified_base (37)..(37): 2'O-Methyl Cytosine
  modified_base (38)..(38): 2' Fluoro Guanosine
cgacuccgcgcggaggguuggagguuacccguuugucg

SEQ ID NO: 4 - RNA, 38 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(20): um
  modified_base (21)..(22): 2'O-Methyl Adenosine
  modified_base (23)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): 2' Fluoro Guanosine
  modified_base (36)..(36): um
  modified_base (37)..(37): 2'O-Methyl Cytosine
  modified_base (38)..(38): 2' Fluoro Guanosine
cgacuccgcgcggagucccuaauuuggggcguuugucg

SEQ ID NO: 5 - RNA, 38 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(21): um
  modified_base (22)..(22): 2'O-Methyl Cytosine
  modified_base (23)..(23): 2'O-Methyl Adenosine
  modified_base (24)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): 2' Fluoro Guanosine
  modified_base (36)..(36): um
  modified_base (37)..(37): 2'O-Methyl Cytosine
  modified_base (38)..(38): 2' Fluoro Guanosine
cgacuccgcgcggagucccuucauuggggcguuugucg

SEQ ID NO: 6 - RNA, 38 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(19): um
  modified_base (20)..(21): 2'O-Methyl Adenosine
  modified_base (22)..(22): um
  modified_base (23)..(24): 2' Fluoro Guanosine
  modified_base (25)..(25): 2'O-Methyl Cytosine
  modified_base (26)..(26): um
  modified_base (27)..(27): 2'O-Methyl Adenosine
  modified_base (28)..(30): 2'O-Methyl Cytosine
  modified_base (31)..(31): 2' Fluoro Guanosine
  modified_base (32)..(34): um
  modified_base (35)..(35): 2' Fluoro Guanosine
  modified_base (36)..(36): um
  modified_base (37)..(37): 2'O-Methyl Cytosine
  modified_base (38)..(38): 2' Fluoro Guanosine
cgacuccgcgcggaggguuaauggcuacccguuugucg

SEQ ID NO: 7 - RNA, 38 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(20): um
  modified_base (21)..(21): 2' Fluoro Guanosine
  modified_base (22)..(22): um
  modified_base (23)..(24): 2'O-Methyl Adenosine
  modified_base (25)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): 2' Fluoro Guanosine
  modified_base (36)..(36): um
  modified_base (37)..(37): 2'O-Methyl Cytosine
  modified_base (38)..(38): 2' Fluoro Guanosine
cgacuccgcgcggagucccuguaauggggcguuugucg

SEQ ID NO: 8 - RNA, 36 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(20): um
  modified_base (21)..(22): 2' Fluoro Guanosine
  modified_base (23)..(23): 2'O-Methyl Cytosine
  modified_base (24)..(24): um
  modified_base (25)..(25): 2'O-Methyl Adenosine
  modified_base (26)..(28): 2'O-Methyl Cytosine
  modified_base (29)..(29): 2' Fluoro Guanosine
  modified_base (30)..(32): um
  modified_base (33)..(33): 2' Fluoro Guanosine
  modified_base (34)..(34): um
  modified_base (35)..(35): 2'O-Methyl Cytosine
  modified_base (36)..(36): 2' Fluoro Guanosine
cgacuccgcgcggaggguuuggcuacccguuugucg

SEQ ID NO: 9 - RNA, 36 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): 2' Fluoro Guanosine
  modified_base (34)..(34): um
  modified_base (35)..(35): 2'O-Methyl Cytosine
  modified_base (36)..(36): 2' Fluoro Guanosine
cgacuccgcgcggaggcuugagguagccguuugucg

SEQ ID NO: 10 - RNA, 36 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(20): 2'O-Methyl Adenosine
  modified_base (21)..(21): 2'O-Methyl Cytosine
  modified_base (22)..(22): 2'O-Methyl Adenosine
  modified_base (23)..(23): um
  modified_base (24)..(27): 2' Fluoro Guanosine
  modified_base (28)..(28): 2'O-Methyl Cytosine
  modified_base (29)..(29): 2' Fluoro Guanosine
  modified_base (30)..(32): um
  modified_base (33)..(33): 2' Fluoro Guanosine
  modified_base (34)..(34): um
  modified_base (35)..(35): 2'O-Methyl Cytosine
  modified_base (36)..(36): 2' Fluoro Guanosine
cgacuccgcgcggagucccacauggggcguuugucg

SEQ ID NO: 11 - RNA, 36 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(18): 2'O-Methyl Adenosine
  modified_base (19)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(25): um
  modified_base (26)..(28): 2'O-Methyl Cytosine
  modified_base (29)..(29): 2' Fluoro Guanosine
  modified_base (30)..(32): um
  modified_base (33)..(33): 2' Fluoro Guanosine
  modified_base (34)..(34): um
  modified_base (35)..(35): 2'O-Methyl Cytosine
  modified_base (36)..(36): 2' Fluoro Guanosine
cgacuccgcgcggagggaugagguucccguuugucg

SEQ ID NO: 12 - RNA, 36 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(18): 2'O-Methyl Adenosine
  modified_base (19)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(25): um
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): 2' Fluoro Guanosine
  modified_base (34)..(34): um
  modified_base (35)..(35): 2'O-Methyl Cytosine
  modified_base (36)..(36): 2' Fluoro Guanosine
cgacuccgcgcggaggcaugagguugccguuugucg

SEQ ID NO: 13 - RNA, 36 nt, Artificial Sequence
  Aptamer
  modified_base (1)..(1): 2'O-Methyl Cytosine
  modified_base (2)..(2): 2' Fluoro Guanosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(17): 2' Fluoro Guanosine
  modified_base (18)..(18): 2'O-Methyl Cytosine
  modified_base (19)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2' Fluoro Guanosine
  modified_base (26)..(26): 2'O-Methyl Cytosine
  modified_base (27)..(27): 2'O-Methyl Adenosine
  modified_base (28)..(28): 2'O-Methyl Cytosine
  modified_base (29)..(29): 2' Fluoro Guanosine
  modified_base (30)..(32): um
  modified_base (33)..(33): 2' Fluoro Guanosine
  modified_base (34)..(34): um
  modified_base (35)..(35): 2'O-Methyl Cytosine
  modified_base (36)..(36): 2' Fluoro Guanosine
cgacuccgcgcggagugcugaggugcacguuugucg

SEQ ID NO: 14 - RNA, 33 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(14): um
  modified_base (15)..(16): 2' Fluoro Guanosine
  modified_base (17)..(17): 2'O-Methyl Adenosine
  modified_base (18)..(19): 2' Fluoro Guanosine
  modified_base (20)..(21): um
  modified_base (22)..(22): 2'O-Methyl Adenosine
  modified_base (23)..(25): 2'O-Methyl Cytosine
  modified_base (26)..(26): 2' Fluoro Guanosine
  modified_base (27)..(29): um
  modified_base (30)..(30): 2' Fluoro Guanosine
  modified_base (31)..(31): um
  modified_base (32)..(32): 2'O-Methyl Cytosine
  modified_base (33)..(33): 2' Fluoro Guanosine
ccgcgcggaggguuggagguuacccguuugucg

SEQ ID NO: 15 - RNA, 33 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(15): um
  modified_base (16)..(17): 2'O-Methyl Adenosine
  modified_base (18)..(20): um
  modified_base (21)..(24): 2' Fluoro Guanosine
  modified_base (25)..(25): 2'O-Methyl Cytosine
  modified_base (26)..(26): 2' Fluoro Guanosine
  modified_base (27)..(29): um
  modified_base (30)..(30): 2' Fluoro Guanosine
  modified_base (31)..(31): um
  modified_base (32)..(32): 2'O-Methyl Cytosine
  modified_base (33)..(33): 2' Fluoro Guanosine
ccgcgcggagucccuaauuuggggcguuugucg

SEQ ID NO: 16 - RNA, 33 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(16): um
  modified_base (17)..(17): 2'O-Methyl Cytosine
  modified_base (18)..(18): 2'O-Methyl Adenosine
  modified_base (19)..(20): um
  modified_base (21)..(24): 2' Fluoro Guanosine
  modified_base (25)..(25): 2'O-Methyl Cytosine
  modified_base (26)..(26): 2' Fluoro Guanosine
  modified_base (27)..(29): um
  modified_base (30)..(30): 2' Fluoro Guanosine
  modified_base (31)..(31): um
  modified_base (32)..(32): 2'O-Methyl Cytosine
  modified_base (33)..(33): 2' Fluoro Guanosine
ccgcgcggagucccuucauuggggcguuugucg

SEQ ID NO: 17 - RNA, 33 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(14): um
  modified_base (15)..(16): 2'O-Methyl Adenosine
  modified_base (17)..(17): um
  modified_base (18)..(19): 2' Fluoro Guanosine
  modified_base (20)..(20): 2'O-Methyl Cytosine
  modified_base (21)..(21): um
  modified_base (22)..(22): 2'O-Methyl Adenosine
  modified_base (23)..(25): 2'O-Methyl Cytosine
  modified_base (26)..(26): 2' Fluoro Guanosine
  modified_base (27)..(29): um
  modified_base (30)..(30): 2' Fluoro Guanosine
  modified_base (31)..(31): um
  modified_base (32)..(32): 2'O-Methyl Cytosine
  modified_base (33)..(33): 2' Fluoro Guanosine
ccgcgcggaggguuaauggcuacccguuugucg

SEQ ID NO: 18 - RNA, 33 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(15): um
  modified_base (16)..(16): 2' Fluoro Guanosine
  modified_base (17)..(17): um
  modified_base (18)..(19): 2'O-Methyl Adenosine
  modified_base (20)..(20): um
  modified_base (21)..(24): 2' Fluoro Guanosine
  modified_base (25)..(25): 2'O-Methyl Cytosine
  modified_base (26)..(26): 2' Fluoro Guanosine
  modified_base (27)..(29): um
  modified_base (30)..(30): 2' Fluoro Guanosine
  modified_base (31)..(31): um
  modified_base (32)..(32): 2'O-Methyl Cytosine
  modified_base (33)..(33): 2' Fluoro Guanosine
ccgcgcggagucccuguaauggggcguuugucg

SEQ ID NO: 19 - RNA, 31 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(15): um
  modified_base (16)..(17): 2' Fluoro Guanosine
  modified_base (18)..(18): 2'O-Methyl Cytosine
  modified_base (19)..(19): um
  modified_base (20)..(20): 2'O-Methyl Adenosine
  modified_base (21)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): 2' Fluoro Guanosine
ccgcgcggaggguuuggcuacccguuugucg

SEQ ID NO: 20 - RNA, 31 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): 2' Fluoro Guanosine
ccgcgcggaggcuugagguagccguuugucg

SEQ ID NO: 21 - RNA, 31 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(15): 2'O-Methyl Adenosine
  modified_base (16)..(16): 2'O-Methyl Cytosine
  modified_base (17)..(17): 2'O-Methyl Adenosine
  modified_base (18)..(18): um
  modified_base (19)..(22): 2' Fluoro Guanosine
  modified_base (23)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): 2' Fluoro Guanosine
ccgcgcggagucccacauggggcguuugucg

SEQ ID NO: 22 - RNA, 31 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): 2'O-Methyl Adenosine
  modified_base (14)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(20): um
  modified_base (21)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): 2' Fluoro Guanosine
ccgcgcggagggaugagguucccguuugucg

SEQ ID NO: 23 - RNA, 31 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(13): 2'O-Methyl Adenosine
  modified_base (14)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(20): um
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): 2' Fluoro Guanosine
ccgcgcggaggcaugagguugccguuugucg

SEQ ID NO: 24 - RNA, 31 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CGAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(12): 2' Fluoro Guanosine
  modified_base (13)..(13): 2'O-Methyl Cytosine
  modified_base (14)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2' Fluoro Guanosine
  modified_base (21)..(21): 2'O-Methyl Cytosine
  modified_base (22)..(22): 2'O-Methyl Adenosine
  modified_base (23)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): 2' Fluoro Guanosine
ccgcgcggagugcugaggugcacguuugucg

SEQ ID NO: 25 - RNA, 38 nt, Artificial Sequence; identical to SEQ ID NO: 3
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(19): um
  modified_base (20)..(21): 2' Fluoro Guanosine
  modified_base (22)..(22): 2'O-Methyl Adenosine
  modified_base (23)..(24): 2' Fluoro Guanosine
  modified_base (25)..(26): um
  modified_base (27)..(27): 2'O-Methyl Adenosine
  modified_base (28)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(38): gm

SEQ ID NO: 26 - RNA, 38 nt, Artificial Sequence; identical to SEQ ID NO: 4
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(20): um
  modified_base (21)..(22): 2'O-Methyl Adenosine
  modified_base (23)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(38): gm

SEQ ID NO: 27 - RNA, 38 nt, Artificial Sequence; identical to SEQ ID NO: 5
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(21): um
  modified_base (22)..(22): 2'O-Methyl Cytosine
  modified_base (23)..(23): 2'O-Methyl Adenosine
  modified_base (24)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(38): gm

SEQ ID NO: 28 - RNA, 38 nt, Artificial Sequence; identical to SEQ ID NO: 6
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(21): um
  modified_base (22)..(22): 2'O-Methyl Cytosine
  modified_base (23)..(23): 2'O-Methyl Adenosine
  modified_base (24)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(38): gm

SEQ ID NO: 29 - RNA, 38 nt, Artificial Sequence; identical to SEQ ID NO: 7
  Apatamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(20): um
  modified_base (21)..(21): 2' Fluoro Guanosine
  modified_base (22)..(22): um
  modified_base (23)..(24): 2'O-Methyl Adenosine
  modified_base (25)..(25): um
  modified_base (26)..(29): 2' Fluoro Guanosine
  modified_base (30)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(38): gm

SEQ ID NO: 30 - RNA, 36 nt, Artificial Sequence; identical to SEQ ID NO: 8
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(20): um
  modified_base (21)..(22): 2' Fluoro Guanosine
  modified_base (23)..(23): 2'O-Methyl Cytosine
  modified_base (24)..(24): um
  modified_base (25)..(25): 2'O-Methyl Adenosine
  modified_base (26)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 31 - RNA, 36 nt, Artificial Sequence; identical to SEQ ID NO: 9
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 32 - RNA, 36 nt, Artificial Sequence; identical to SEQ ID NO: 10
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(19): 2'O-Methyl Cytosine
  modified_base (20)..(20): 2'O-Methyl Adenosine
  modified_base (21)..(21): 2'O-Methyl Cytosine
  modified_base (22)..(22): 2'O-Methyl Adenosine
  modified_base (23)..(23): um
  modified_base (24)..(27): 2' Fluoro Guanosine
  modified_base (28)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 33 - RNA, 36 nt, Artificial Sequence; identical to SEQ ID NO: 11
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(17): 2' Fluoro Guanosine
  modified_base (18)..(18): 2'O-Methyl Adenosine
  modified_base (19)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(25): um
  modified_base (26)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 34 - RNA, 36 nt, Artificial Sequence; identical to SEQ ID NO: 12
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(18): 2'O-Methyl Adenosine
  modified_base (19)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(25): um
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 35 - RNA, 36 nt, Artificial Sequence; identical to SEQ ID NO: 13
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(15): 2' Fluoro Guanosine
  modified_base (16)..(16): um
  modified_base (17)..(17): 2' Fluoro Guanosine
  modified_base (18)..(18): 2'O-Methyl Cytosine
  modified_base (19)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2' Fluoro Guanosine
  modified_base (26)..(26): 2'O-Methyl Cytosine
  modified_base (27)..(27): 2'O-Methyl Adenosine
  modified_base (28)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 36 - RNA, 33 nt, Artificial Sequence; identical to SEQ ID NO: 14
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(14): um
  modified_base (15)..(16): 2' Fluoro Guanosine
  modified_base (17)..(17): 2'O-Methyl Adenosine
  modified_base (18)..(19): 2' Fluoro Guanosine
  modified_base (20)..(21): um
  modified_base (22)..(22): 2'O-Methyl Adenosine
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm

SEQ ID NO: 37 - RNA, 33 nt, Artificial Sequence; identical to SEQ ID NO: 15
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(15): um
  modified_base (16)..(17): 2'O-Methyl Adenosine
  modified_base (18)..(20): um
  modified_base (21)..(24): 2' Fluoro Guanosine
  modified_base (25)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm

SEQ ID NO: 38 - RNA, 33 nt, Artificial Sequence; identical to SEQ ID NO: 16
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(16): um
  modified_base (17)..(17): 2'O-Methyl Cytosine
  modified_base (18)..(18): 2'O-Methyl Adenosine
  modified_base (19)..(20): um
  modified_base (21)..(24): 2' Fluoro Guanosine
  modified_base (25)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm

SEQ ID NO: 39 - RNA, 33 nt, Artificial Sequence; identical to SEQ ID NO: 17
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(14): um
  modified_base (15)..(16): 2'O-Methyl Adenosine
  modified_base (17)..(17): um
  modified_base (18)..(19): 2' Fluoro Guanosine
  modified_base (20)..(20): 2'O-Methyl Cytosine
  modified_base (21)..(21): um
  modified_base (22)..(22): 2'O-Methyl Adenosine
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm

SEQ ID NO: 40 - RNA, 33 nt, Artificial Sequence; identical to SEQ ID NO: 18
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(15): um
  modified_base (16)..(16): 2' Fluoro Guanosine
  modified_base (17)..(17): um
  modified_base (18)..(19): 2'O-Methyl Adenosine
  modified_base (20)..(20): um
  modified_base (21)..(24): 2' Fluoro Guanosine
  modified_base (25)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm

SEQ ID NO: 41 - RNA, 31 nt, Artificial Sequence; identical to SEQ ID NO: 19
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(15): um
  modified_base (16)..(17): 2' Fluoro Guanosine
  modified_base (18)..(18): 2'O-Methyl Cytosine
  modified_base (19)..(19): um
  modified_base (20)..(20): 2'O-Methyl Adenosine
  modified_base (21)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm

SEQ ID NO: 42 - RNA, 31 nt, Artificial Sequence; identical to SEQ ID NO: 20
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm

SEQ ID NO: 43 - RNA, 31 nt, Artificial Sequence; identical to SEQ ID NO: 21
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(14): 2'O-Methyl Cytosine
  modified_base (15)..(15): 2'O-Methyl Adenosine
  modified_base (16)..(16): 2'O-Methyl Cytosine
  modified_base (17)..(17): 2'O-Methyl Adenosine
  modified_base (18)..(18): um
  modified_base (19)..(22): 2' Fluoro Guanosine
  modified_base (23)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm

SEQ ID NO: 44 - RNA, 31 nt, Artificial Sequence; identical to SEQ ID NO: 22
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): 2'O-Methyl Adenosine
  modified_base (14)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(20): um
  modified_base (21)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm

SEQ ID NO: 45 - RNA, 31 nt, Artificial Sequence; identical to SEQ ID NO: 23
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(13): 2'O-Methyl Adenosine
  modified_base (14)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(20): um
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm

SEQ ID NO: 46 - RNA, 31 nt, Artificial Sequence; identical to SEQ ID NO: 24
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(10): 2' Fluoro Guanosine
  modified_base (11)..(11): um
  modified_base (12)..(12): 2' Fluoro Guanosine
  modified_base (13)..(13): 2'O-Methyl Cytosine
  modified_base (14)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2' Fluoro Guanosine
  modified_base (21)..(21): 2'O-Methyl Cytosine
  modified_base (22)..(22): 2'O-Methyl Adenosine
  modified_base (23)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm

SEQ ID NO: 47 - RNA, 29 nt, Artificial Sequence
  Aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
gcggugggaaaugugagauggguugccgc

SEQ ID NO: 48 - RNA, 34 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
ggcgacgguagauuaugggcagugugaccgcgcc

SEQ ID NO: 49 - RNA, 31 nt, Artificial Sequence
  Aptamer
  modified_base (1)..(1): gm
  modified_base (2)..(3): 2' Fluoro Guanosine
  modified_base (4)..(4): 2'O-Methyl Cytosine
  modified_base (5)..(7): 2'O-Methyl Adenosine
  modified_base (8)..(9): 2' Fluoro Guanosine
  modified_base (10)..(10): 2'O-Methyl Cytosine
  modified_base (11)..(13): 2'O-Methyl Adenosine
  modified_base (14)..(14): um
  modified_base (15)..(15): 2'O-Methyl Cytosine
  modified_base (16)..(19): 2'O-Methyl Adenosine
  modified_base (20)..(21): 2'O-Methyl Cytosine
  modified_base (22)..(22): 2' Fluoro Guanosine
  modified_base (23)..(24): um
  modified_base (25)..(25): 2'O-Methyl Adenosine
  modified_base (26)..(26): 2'O-Methyl Cytosine
  modified_base (27)..(28): 2'O-Methyl Adenosine
  modified_base (29)..(31): 2'O-Methyl Cytosine
gggcaaaggcaaaucaaaaccguuacaaccc

SEQ ID NO: 50 - RNA, 34 nt, Artificial Sequence
  Aptamer
  modified_base (1)..(1): 2'O-Methyl Adenosine
  modified_base (2)..(2): 2'O-Methyl Cytosine
  modified_base (3)..(6): 2' Fluoro Guanosine
  modified_base (7)..(7): 2'O-Methyl Cytosine
  modified_base (8)..(9): 2'O-Methyl Adenosine
  modified_base (10)..(10): um
  modified_base (11)..(12): 2'O-Methyl Cytosine
  modified_base (13)..(13): um
  modified_base (14)..(14): 2' Fluoro Guanosine
  modified_base (15)..(16): 2'O-Methyl Cytosine
  modified_base (17)..(17): 2' Fluoro Guanosine
  modified_base (18)..(21): um
  modified_base (22)..(22): 2'O-Methyl Adenosine
  modified_base (23)..(23): 2'O-Methyl Cytosine
  modified_base (24)..(24): 2'O-Methyl Adenosine
  modified_base (25)..(26): 2' Fluoro Guanosine
  modified_base (27)..(27): um
  modified_base (28)..(30): 2'O-Methyl Adenosine
  modified_base (31)..(31): gm
  modified_base (32)..(33): 2'O-Methyl Cytosine
  modified_base (34)..(34): 2' Fluoro Guanosine
acggggcaauccugccguuuuacagguaaagccg

SEQ ID NO: 51 - RNA, 38 nt, Artificial Sequence
  Aptamer
  modified_base (1)..(1): 2'Fluoro Cytosine
  modified_base (2)..(2): gm
  modified_base (3)..(4): 2'Fluoro Cytosine
  modified_base (6)..(6): 2'Fluoro Cytosine
  modified_base (7)..(8): gm
  modified_base (9)..(9): 2'Fluoro Uridine
  modified_base (10)..(10): 2'Fluoro Cytosine
  modified_base (11)..(11): 2'Fluoro Uridine
  modified_base (12)..(12): 2'Fluoro Cytosine
  modified_base (14)..(15): gm
  modified_base (16)..(16): 2'Fluoro Cytosine
  modified_base (18)..(18): 2'Fluoro Cytosine
  modified_base (19)..(19): 2'Fluoro Uridine
  modified_base (20)..(20): gm
  modified_base (22)..(22): gm
  modified_base (23)..(23): 2'Fluoro Uridine
  modified_base (24)..(24): 2'Fluoro Cytosine
  modified_base (25)..(25): 2'Fluoro Uridine
  modified_base (26)..(26): gm
  modified_base (28)..(28): gm
  modified_base (29)..(31): 2'Fluoro Uridine
  modified_base (33)..(34): 2'Fluoro Cytosine
  modified_base (35)..(35): 2'Fluoro Uridine
  modified_base (36)..(36): gm
  modified_base (37)..(37): 2'Fluoro Cytosine
  modified_base (38)..(38): gm
cgccgcggucucaggcgcugagucugaguuuaccugcg

SEQ ID NO: 52 - DNA, 12 bp, Artificial Sequence
  Aptamer
  misc_feature (1)..(1): The cytosine is attached  through the linker Hexaethyleneglycol spacer to 2'O-Methyl guanosine of another nucleotide sequence caggcUaCX
  modified_base (5)..(5): gm
  modified_base (7)..(7): gm
  modified_base (10)..(10): um
  modified_base (11)..(11): 2'O-Methyl Cytosine
  misc_feature (12)..(12): The 2'O-Methyl adenosine is attached  through the linker Hexaethyleneglycol spacer to thymine of another nucleotide sequence tgatCCUX
  modified_base (12)..(12): 2'O-Methyl Adenosine
cgtagagcatca

SEQ ID NO: 53 - RNA, 36 nt, Artificial Sequence
  Aptamer
  modified_base (1)..(3): gm
  modified_base (4)..(4): 2'O-Methyl Adenosine
  modified_base (5)..(5): um
  modified_base (6)..(6): 2'O-Methyl Adenosine
  modified_base (7)..(7): 2'O-Methyl Cytosine
  modified_base (8)..(8): 2'Fluoro Uridine
  modified_base (9)..(9): 2'O-Methyl Adenosine
  modified_base (10)..(11): gm
  modified_base (12)..(12): (rG)
  modified_base (13)..(13): 2'O-Methyl Cytosine
  modified_base (14)..(14): 2'O-Methyl Adenosine
  modified_base (15)..(15): um
  modified_base (16)..(16): 2'Fluoro Uridine
  modified_base (17)..(18): 2'O-Methyl Adenosine
  modified_base (19)..(19): um
  modified_base (20)..(20): gm
  modified_base (21)..(21): 2'Fluoro Uridine
  modified_base (22)..(22): um
  modified_base (23)..(23): 2'O-Methyl Adenosine
  modified_base (24)..(25): 2'O-Methyl Cytosine
  modified_base (26)..(26): 2'O-Methyl Adenosine
  modified_base (27)..(27): (rG)
  modified_base (28)..(28): 2'Fluoro Uridine
  modified_base (29)..(29): (rG)
  modified_base (30)..(30): 2'Fluoro Uridine
  modified_base (31)..(31): 2'O-Methyl Adenosine
  modified_base (32)..(32): gm
  modified_base (33)..(33): um
  modified_base (34)..(36): 2'O-Methyl Cytosine
gggauacuagggcauuaauguuaccaguguaguccc

SEQ ID NO: 54 - RNA, 39 nt, Artificial Sequence
  Aptamer
  modified_base (1)..(2): 2'O-Methyl Cytosine
  modified_base (3)..(3): gm
  modified_base (4)..(5): 2'O-Methyl Cytosine
  modified_base (6)..(7): um
  modified_base (8)..(8): 2' Fluoro Guanosine
  modified_base (9)..(10): 2'O-Methyl Cytosine
  modified_base (11)..(11): 2'O-Methyl Adenosine
  modified_base (12)..(12): 2' Fluoro Guanosine
  modified_base (13)..(13): um
  modified_base (14)..(14): 2'O-Methyl Adenosine
  modified_base (15)..(16): um
  modified_base (17)..(18): 2' Fluoro Guanosine
  modified_base (19)..(19): 2'O-Methyl Cytosine
  modified_base (20)..(21): um
  modified_base (22)..(22): 2'O-Methyl Adenosine
  modified_base (23)..(24): 2' Fluoro Guanosine
  modified_base (25)..(25): 2'O-Methyl Cytosine
  modified_base (26)..(26): um
  modified_base (27)..(28): 2' Fluoro Guanosine
  modified_base (29)..(30): 2'O-Methyl Adenosine
  modified_base (31)..(31): 2' Fluoro Guanosine
  modified_base (32)..(34): um
  modified_base (35)..(36): gm
  modified_base (37)..(37): 2'O-Methyl Cytosine
  modified_base (38)..(39): gm
ccgccuugccaguauuggcuuaggcuggaaguuuggcgg

SEQ ID NO: 55 - RNA, 33 nt, Artificial Sequence; identical to SEQ ID NO: 1
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 56 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 57 - RNA, 67 nt, Artificial Sequence
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(35): gm
  modified_base (36)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  modified_base (40)..(41): gm
  modified_base (42)..(42): um
  modified_base (43)..(43): 2'O-Methyl Adenosine
  modified_base (44)..(44): gm
  modified_base (45)..(45): 2'O-Methyl Adenosine
  modified_base (46)..(47): um
  modified_base (48)..(48): 2'O-Methyl Adenosine
  modified_base (49)..(49): um
  modified_base (50)..(52): 2' Fluoro Guanosine
  modified_base (53)..(53): 2'O-Methyl Cytosine
  modified_base (54)..(54): 2'O-Methyl Adenosine
  modified_base (55)..(55): 2' Fluoro Guanosine
  modified_base (56)..(56): um
  modified_base (57)..(57): 2' Fluoro Guanosine
  modified_base (58)..(58): um
  modified_base (59)..(59): 2' Fluoro Guanosine
  modified_base (60)..(60): 2'O-Methyl Adenosine
  modified_base (61)..(62): 2'O-Methyl Cytosine
  modified_base (63)..(63): gm
  modified_base (64)..(64): 2'O-Methyl Cytosine
  modified_base (65)..(65): gm
  modified_base (66)..(67): 2'O-Methyl Cytosine
  modified_base (67)..(67): inverted deoxythymidine incorporated at the 3'  end
ccgcgcggagggguuucauaaucccguuugucgggcgacgguagauuaugggcagugugaccgcgcc

SEQ ID NO: 58 - RNA, 33 nt, Artificial Sequence; identical to SEQ ID NO: 1
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  misc_feature (33)..(33): The 2'O-Methyl guanosine is attached  through the linker 1,3-propanediolspacer to 2'O-Methyl guanosine of SEQ ID NO: 391
  modified_base (33)..(33): gm

SEQ ID NO: 59 - RNA, 33 nt, Artificial Sequence; identical to SEQ ID NO: 1
  Aptamer
  misc_feature (1)..(1): The 2'O-Methyl cytosine is attached through the linker 1,3-propanediolspacer to another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  misc_feature (33)..(33): The 2'O-Methyl guanosine is attached through the linker Hexaethylene glycol spacer to 2'O-Methyl guanosine of SEQ ID NO:392
  modified_base (33)..(33): gm

SEQ ID NO: 60 - RNA, 72 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (34)..(38): 2'O-Methyl deoxyuridine linker
  modified_base (34)..(38): 2'O-Methyl deoxyuridine
  modified_base (39)..(40): gm
  modified_base (41)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(46): gm
  modified_base (47)..(47): um
  modified_base (48)..(48): 2'O-Methyl Adenosine
  modified_base (49)..(49): gm
  modified_base (50)..(50): 2'O-Methyl Adenosine
  modified_base (51)..(52): um
  modified_base (53)..(53): 2'O-Methyl Adenosine
  modified_base (54)..(54): um
  modified_base (55)..(57): 2' Fluoro Guanosine
  modified_base (58)..(58): 2'O-Methyl Cytosine
  modified_base (59)..(59): 2'O-Methyl Adenosine
  modified_base (60)..(60): 2' Fluoro Guanosine
  modified_base (61)..(61): um
  modified_base (62)..(62): 2' Fluoro Guanosine
  modified_base (63)..(63): um
  modified_base (64)..(64): 2' Fluoro Guanosine
  modified_base (65)..(65): 2'O-Methyl Adenosine
  modified_base (66)..(67): 2'O-Methyl Cytosine
  modified_base (68)..(68): gm
  modified_base (69)..(69): 2'O-Methyl Cytosine
  modified_base (70)..(70): gm
  modified_base (71)..(72): 2'O-Methyl Cytosine
  modified_base (72)..(72): inverted deoxythymidine incorporated at the 3'  end
ccgcgcggagggguuucauaaucccguuugucguuuuuggcgacgguagauuaugggcagugugaccgcgcc

SEQ ID NO: 61 - RNA, 77 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (34)..(43): 2'O-Methyl deoxyuridine linker
  modified_base (34)..(43): 2'O-Methyl deoxyuridine
  modified_base (44)..(45): gm
  modified_base (46)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  modified_base (50)..(51): gm
  modified_base (52)..(52): um
  modified_base (53)..(53): 2'O-Methyl Adenosine
  modified_base (54)..(54): gm
  modified_base (55)..(55): 2'O-Methyl Adenosine
  modified_base (56)..(57): um
  modified_base (58)..(58): 2'O-Methyl Adenosine
  modified_base (59)..(59): um
  modified_base (60)..(62): 2' Fluoro Guanosine
  modified_base (63)..(63): 2'O-Methyl Cytosine
  modified_base (64)..(64): 2'O-Methyl Adenosine
  modified_base (65)..(65): 2' Fluoro Guanosine
  modified_base (66)..(66): um
  modified_base (67)..(67): 2' Fluoro Guanosine
  modified_base (68)..(68): um
  modified_base (69)..(69): 2' Fluoro Guanosine
  modified_base (70)..(70): 2'O-Methyl Adenosine
  modified_base (71)..(72): 2'O-Methyl Cytosine
  modified_base (73)..(73): gm
  modified_base (74)..(74): 2'O-Methyl Cytosine
  modified_base (75)..(75): gm
  modified_base (76)..(77): 2'O-Methyl Cytosine
  modified_base (77)..(77): inverted deoxythymidine incorporated at the 3'  end
ccgcgcggagggguuucauaaucccguuugucguuuuuuuuuuggcgacgguagauuaugggcagugugaccgcgcc

SEQ ID NO: 62 - RNA, 38 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (9)..(9): 2' Fluoro Guanosine
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (13)..(14): 2' Fluoro Guanosine
  modified_base (15)..(15): 2'O-Methyl Adenosine
  modified_base (16)..(16): um
  modified_base (16)..(16): 2' Fluoro Guanosine
  modified_base (20)..(20): 2'O-Methyl Cytosine
  modified_base (21)..(21): 2'O-Methyl Adenosine
  modified_base (23)..(23): um
  modified_base (23)..(23): 2' Fluoro Guanosine
  modified_base (25)..(25): um
  modified_base (25)..(25): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(35): 2'O-Methyl Cytosine
  modified_base (36)..(36): gm
  modified_base (37)..(37): 2'O-Methyl Adenosine
  misc_feature (38)..(38): The 2'O-Methyl cytosine is attached  through the linker 1,3-propanediolspacer to 2'O-Methyl cytosine of SEQ ID NO: 393
  modified_base (38)..(38): 2'O-Methyl Cytosine
ggcgacgguagauuaugggcagugugaccgcgcccgac

SEQ ID NO: 63 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker 1,3-propanediolspacer to 2'O-Methyl cytosine of another nucleotide sequence CXAC

SEQ ID NO: 64 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker Hexaethyleneglycol spacer to 2'O-Methyl cytosine of another nucleotide sequence CXAC

SEQ ID NO: 65 - RNA, 43 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(39): 2'O-Methyl deoxyuridine linker
  modified_base (35)..(39): um
  modified_base (40)..(40): 2'O-Methyl Cytosine
  modified_base (41)..(41): gm
  modified_base (42)..(42): 2'O-Methyl Adenosine
  misc_feature (43)..(43): The 2'O-Methyl cytosine is attached  through the linker 1,3-propanediolspacer to 2'O-Methyl cytosine of SEQ ID NO: 396
  modified_base (43)..(43): 2'O-Methyl Cytosine
ggcgacgguagauuaugggcagugugaccgcgccuuuuucgac

SEQ ID NO: 66 - RNA, 48 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(44): 2'O-Methyl deoxyuridine
  misc_feature (35)..(44): 2'O-Methyl deoxyuridine linker
  misc_feature (48)..(48): The 2'O-Methyl cytosine is attached  through the linker 1,3-propanediolspacer to 2'O-Methyl cytosine of SEQ ID NO: 397
ggcgacgguagauuaugggcagugugaccgcgccuuuuuuuuuucgac

SEQ ID NO: 67 - RNA, 35 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): inverted deoxythymidine incorporated at the 3'  end
  modified_base (35)..(35): 2'O-Methyl Cytosine
ccgcgcggagggguuucauaaucccguuugucggc

SEQ ID NO: 68 - RNA, 69 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence XCCXAC.
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(25): 2'O-Methyl Cytosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(37): gm
  modified_base (38)..(38): 2'O-Methyl Cytosine
  modified_base (39)..(39): gm
  modified_base (40)..(40): 2'O-Methyl Adenosine
  modified_base (41)..(41): 2'O-Methyl Cytosine
  modified_base (42)..(43): gm
  modified_base (44)..(44): um
  modified_base (45)..(45): 2'O-Methyl Adenosine
  modified_base (46)..(46): gm
  modified_base (47)..(47): 2'O-Methyl Adenosine
  modified_base (48)..(49): um
  modified_base (50)..(50): 2'O-Methyl Adenosine
  modified_base (51)..(51): um
  modified_base (52)..(54): 2' Fluoro Guanosine
  modified_base (55)..(55): 2'O-Methyl Cytosine
  modified_base (56)..(56): 2'O-Methyl Adenosine
  modified_base (57)..(57): 2' Fluoro Guanosine
  modified_base (58)..(58): um
  modified_base (59)..(59): 2' Fluoro Guanosine
  modified_base (60)..(60): um
  modified_base (61)..(61): 2' Fluoro Guanosine
  modified_base (62)..(62): 2'O-Methyl Adenosine
  modified_base (63)..(64): 2'O-Methyl Cytosine
  modified_base (65)..(65): gm
  modified_base (66)..(66): 2'O-Methyl Cytosine
  modified_base (67)..(67): gm
  modified_base (68)..(69): 2'O-Methyl Cytosine
  misc_feature (69)..(69): inverted deoxythymidine incorporated at the 3'  end
ccgcgcggagggguuucauaaucccguuugucggcggcgacgguagauuaugggcagugugaccgcgcc

SEQ ID NO: 69 - RNA, 35 nt, Artificial Sequence; identical to SEQ ID NO: 67
  Aptamer
  misc_feature (1)..(1): The 2'O-Methyl cytosine is attached  through the linker 1,3-propanediolspacer to 2'O-Methyl cytosine of another nucleotide sequence XCCXAC.
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  misc_feature (35)..(35): The 2'O-Methyl cytosine is attached  through the linker 1,3-propanediolspacer to 2'O-Methyl guanosine of SEQ ID NO: 398
  modified_base (35)..(35): 2'O-Methyl Cytosine

SEQ ID NO: 70 - RNA, 35 nt, Artificial Sequence; identical to SEQ ID NO: 67
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  misc_feature (35)..(35): The 2'O-Methyl cytosine is attached through the linker Hexaethylene glycol spacer to 2'O-Methyl guanosine of SEQ ID NO:399
  modified_base (35)..(35): 2'O-Methyl Cytosine

SEQ ID NO: 71 - RNA, 74 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (36)..(40): 2'O-Methyl deoxyuridine linker
  modified_base (36)..(40): 2'O-Methyl deoxyuridine
  modified_base (41)..(42): gm
  modified_base (43)..(43): 2'O-Methyl Cytosine
  modified_base (44)..(44): gm
  modified_base (45)..(45): 2'O-Methyl Adenosine
  modified_base (46)..(46): 2'O-Methyl Cytosine
  modified_base (47)..(48): gm
  modified_base (49)..(49): um
  modified_base (50)..(50): 2'O-Methyl Adenosine
  modified_base (51)..(51): gm
  modified_base (52)..(52): 2'O-Methyl Adenosine
  modified_base (53)..(54): um
  modified_base (55)..(55): 2'O-Methyl Adenosine
  modified_base (56)..(56): um
  modified_base (57)..(59): 2' Fluoro Guanosine
  modified_base (60)..(60): 2'O-Methyl Cytosine
  modified_base (61)..(61): 2'O-Methyl Adenosine
  modified_base (62)..(62): 2' Fluoro Guanosine
  modified_base (63)..(63): um
  modified_base (64)..(64): 2' Fluoro Guanosine
  modified_base (65)..(65): um
  modified_base (66)..(66): 2' Fluoro Guanosine
  modified_base (67)..(67): 2'O-Methyl Adenosine
  modified_base (68)..(69): 2'O-Methyl Cytosine
  modified_base (70)..(70): gm
  modified_base (71)..(71): 2'O-Methyl Cytosine
  modified_base (72)..(72): gm
  modified_base (73)..(74): 2'O-Methyl Cytosine
  misc_feature (74)..(74): inverted deoxythymidine incorporated at the 3'  end
ccgcgcggagggguuucauaaucccguuugucggcuuuuuggcgacgguagauuaugggcagugugaccgcgcc

SEQ ID NO: 72 - RNA, 79 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence XCCXAC.
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (36)..(45): 2'O-Methyl deoxyuridine linker
  modified_base (36)..(45): 2'O-Methyl deoxyuridine
  modified_base (46)..(47): gm
  modified_base (48)..(48): 2'O-Methyl Cytosine
  modified_base (49)..(49): gm
  modified_base (50)..(50): 2'O-Methyl Adenosine
  modified_base (51)..(51): 2'O-Methyl Cytosine
  modified_base (52)..(53): gm
  modified_base (54)..(54): um
  modified_base (55)..(55): 2'O-Methyl Adenosine
  modified_base (56)..(56): gm
  modified_base (57)..(57): 2'O-Methyl Adenosine
  modified_base (58)..(59): um
  modified_base (60)..(60): 2'O-Methyl Adenosine
  modified_base (61)..(61): um
  modified_base (62)..(64): 2' Fluoro Guanosine
  modified_base (65)..(65): 2'O-Methyl Cytosine
  modified_base (66)..(66): 2'O-Methyl Adenosine
  modified_base (67)..(67): 2' Fluoro Guanosine
  modified_base (68)..(68): um
  modified_base (69)..(69): 2' Fluoro Guanosine
  modified_base (70)..(70): um
  modified_base (71)..(71): 2' Fluoro Guanosine
  modified_base (72)..(72): 2'O-Methyl Adenosine
  modified_base (73)..(74): 2'O-Methyl Cytosine
  modified_base (75)..(75): gm
  modified_base (76)..(76): 2'O-Methyl Cytosine
  modified_base (77)..(77): gm
  modified_base (78)..(79): 2'O-Methyl Cytosine
  modified_base (79)..(79): inverted deoxythymidine incorporated at the 3'  end
ccgcgcggagggguuucauaaucccguuugucggcuuuuuuuuuuggcgacgguagauuaugggcagugugaccgcgcc

SEQ ID NO: 73 - RNA, 40 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(35): gm
  modified_base (36)..(37): 2'O-Methyl Cytosine
  modified_base (38)..(38): gm
  modified_base (39)..(39): 2'O-Methyl Adenosine
  misc_feature (40)..(40): The 2'O-Methyl cytosine is attached  through the linker 1,3-propanediolspacer to 2'O-Methyl cytosine of SEQ ID NO: 400
  misc_feature (40)..(40): The 2'O-Methyl cytosine is attached  through the linker 1,3-propanediolspacer to 2'O-Methyl cytosine of SEQ ID NO: 302
  modified_base (40)..(40): 2'O-Methyl Cytosine
ggcgacgguagauuaugggcagugugaccgcgccgccgac

SEQ ID NO: 74 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached through the linker 1,3-propanediolspacer to 2'O-Methyl guanosine of another nucleotide sequence XCCXAC.

SEQ ID NO: 75 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker Hexaethyleneglycol spacer to 2'O-Methyl guanosine of another nucleotide sequence XCCXAC

SEQ ID NO: 76 - RNA, 45 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(39): 2'O-Methyl deoxyuridine linker
  modified_base (35)..(39): 2'O-Methyl deoxyuridine
  modified_base (40)..(40): gm
  modified_base (41)..(42): 2'O-Methyl Cytosine
  modified_base (43)..(43): gm
  modified_base (44)..(44): 2'O-Methyl Adenosine
  misc_feature (45)..(45): The 2'O-Methyl cytosine is attached  through the linker 1,3-propanediolspacer to 2'O-Methyl cytosine of SEQ ID NO: 403
  misc_feature (45)..(45): The 2'O-Methyl cytosine is attached through the linker 1,3-propanediolspacer to 2'O-Methyl cytosine of SEQ ID NO:302
  modified_base (45)..(45): 2'O-Methyl Cytosine
ggcgacgguagauuaugggcagugugaccgcgccuuuuugccgac

SEQ ID NO: 77 - RNA, 50 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(44): 2'O-Methyl deoxyuridine linker
  modified_base (35)..(44): 2'O-Methyl deoxyuridine
  modified_base (45)..(45): gm
  modified_base (46)..(47): 2'O-Methyl Cytosine
  modified_base (48)..(48): gm
  modified_base (49)..(49): 2'O-Methyl Adenosine
  misc_feature (50)..(50): The 2'O-Methyl cytosine is attached  through the linker 1,3-propanediolspacer to 2'O-Methyl cytosine of SEQ ID NO: 404
  misc_feature (50)..(50): The 2'O-Methyl cytosine is attached through the linker 1,3-propanediolspacer to 2'O-Methyl cytosine of SEQ ID NO:302
  modified_base (50)..(50): 2'O-Methyl Cytosine
ggcgacgguagauuaugggcagugugaccgcgccuuuuuuuuuugccgac

SEQ ID NO: 78 - RNA, 38 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): inverted deoxythymidine incorporated at the 3'  end
  modified_base (38)..(38): 2'O-Methyl Cytosine
gcggcgacgguagauuaugggcagugugaccgcgccgc

SEQ ID NO: 79 - RNA, 71 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC.
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(37): gm
  modified_base (38)..(38): 2'O-Methyl Cytosine
  modified_base (39)..(39): gm
  modified_base (40)..(40): 2'O-Methyl Adenosine
  modified_base (41)..(41): 2'O-Methyl Cytosine
  modified_base (42)..(43): gm
  modified_base (44)..(44): um
  modified_base (45)..(45): 2'O-Methyl Adenosine
  modified_base (46)..(46): gm
  modified_base (47)..(47): 2'O-Methyl Adenosine
  modified_base (48)..(49): um
  modified_base (50)..(50): 2'O-Methyl Adenosine
  modified_base (51)..(51): um
  modified_base (52)..(54): 2' Fluoro Guanosine
  modified_base (55)..(55): 2'O-Methyl Cytosine
  modified_base (56)..(56): 2'O-Methyl Adenosine
  modified_base (57)..(57): 2' Fluoro Guanosine
  modified_base (58)..(58): um
  modified_base (59)..(59): 2' Fluoro Guanosine
  modified_base (60)..(60): um
  modified_base (61)..(61): 2' Fluoro Guanosine
  modified_base (62)..(62): 2'O-Methyl Adenosine
  modified_base (63)..(64): 2'O-Methyl Cytosine
  modified_base (65)..(65): gm
  modified_base (66)..(66): 2'O-Methyl Cytosine
  modified_base (67)..(67): gm
  modified_base (68)..(69): 2'O-Methyl Cytosine
  modified_base (70)..(70): gm
  modified_base (71)..(71): inverted deoxythymidine incorporated at the 3'  end
  modified_base (71)..(71): 2'O-Methyl Cytosine
ccgcgcggagggguuucauaaucccguuugucggcggcgacgguagauuaugggcagugugaccgcgccgc

SEQ ID NO: 80 - RNA, 33 nt, Artificial Sequence; identical to SEQ ID NO: 1
  Aptamer
  misc_feature (1)..(1): The 2'O-Methyl cytosine is attached  through the linker 1,3-propanediolspacer to 2'O-Methyl cytosine of another nucleotide sequence CXAC.
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  misc_feature (33)..(33): The 2'O-Methyl guanosine is attached  through the linker 1,3-propanediolspacer to 2'O-Methyl guanosine of SEQ ID NO: 405
  modified_base (33)..(33): gm

SEQ ID NO: 81 - RNA, 33 nt, Artificial Sequence; identical to SEQ ID NO: 1
  Aptamer
  misc_feature (1)..(1): The 2'O-Methyl cytosine is attached  through the linker 1,3-propanediolspacer to 2'O-Methyl cytosine of another nucleotide sequence CXAC.
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  misc_feature (33)..(33): The 2'O-Methyl guanosine is attached through the linker Hexaethyleneglycol spacer to 2'O-Methyl guanosine of  SEQ ID NO: 406
  modified_base (33)..(33): gm

SEQ ID NO: 82 - RNA, 76 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (34)..(38): 2'O-Methyl deoxyuridine linker
  modified_base (34)..(38): 2'O-Methyl deoxyuridine
  modified_base (39)..(39): gm
  modified_base (40)..(40): 2'O-Methyl Cytosine
  modified_base (41)..(42): gm
  modified_base (43)..(43): 2'O-Methyl Cytosine
  modified_base (44)..(44): gm
  modified_base (45)..(45): 2'O-Methyl Adenosine
  modified_base (46)..(46): 2'O-Methyl Cytosine
  modified_base (47)..(48): gm
  modified_base (49)..(49): um
  modified_base (50)..(50): 2'O-Methyl Adenosine
  modified_base (51)..(51): gm
  modified_base (52)..(52): 2'O-Methyl Adenosine
  modified_base (53)..(54): um
  modified_base (55)..(55): 2'O-Methyl Adenosine
  modified_base (56)..(56): um
  modified_base (57)..(59): 2' Fluoro Guanosine
  modified_base (60)..(60): 2'O-Methyl Cytosine
  modified_base (61)..(61): 2'O-Methyl Adenosine
  modified_base (62)..(62): 2' Fluoro Guanosine
  modified_base (63)..(63): um
  modified_base (64)..(64): 2' Fluoro Guanosine
  modified_base (65)..(65): um
  modified_base (66)..(66): 2' Fluoro Guanosine
  modified_base (67)..(67): 2'O-Methyl Adenosine
  modified_base (68)..(69): 2'O-Methyl Cytosine
  modified_base (70)..(70): gm
  modified_base (71)..(71): 2'O-Methyl Cytosine
  modified_base (72)..(72): gm
  modified_base (73)..(74): 2'O-Methyl Cytosine
  modified_base (75)..(75): gm
  modified_base (76)..(76): inverted deoxythymidine incorporated at the 3'  end
  modified_base (76)..(76): 2'O-Methyl Cytosine
ccgcgcggagggguuucauaaucccguuugucguuuuugcggcgacgguagauuaugggcagugugaccgcgccgc

SEQ ID NO: 83 - RNA, 81 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (34)..(43): 2'O-Methyl deoxyuridine linker
  modified_base (34)..(43): 2'O-Methyl deoxyuridine
  modified_base (44)..(44): gm
  modified_base (45)..(45): 2'O-Methyl Cytosine
  modified_base (46)..(47): gm
  modified_base (48)..(48): 2'O-Methyl Cytosine
  modified_base (49)..(49): gm
  modified_base (50)..(50): 2'O-Methyl Adenosine
  modified_base (51)..(51): 2'O-Methyl Cytosine
  modified_base (52)..(53): gm
  modified_base (54)..(54): um
  modified_base (55)..(55): 2'O-Methyl Adenosine
  modified_base (56)..(56): gm
  modified_base (57)..(57): 2'O-Methyl Adenosine
  modified_base (58)..(59): um
  modified_base (60)..(60): 2'O-Methyl Adenosine
  modified_base (61)..(61): um
  modified_base (62)..(64): 2' Fluoro Guanosine
  modified_base (65)..(65): 2'O-Methyl Cytosine
  modified_base (66)..(66): 2'O-Methyl Adenosine
  modified_base (67)..(67): 2' Fluoro Guanosine
  modified_base (68)..(68): um
  modified_base (69)..(69): 2' Fluoro Guanosine
  modified_base (70)..(70): um
  modified_base (71)..(71): 2' Fluoro Guanosine
  modified_base (72)..(72): 2'O-Methyl Adenosine
  modified_base (73)..(74): 2'O-Methyl Cytosine
  modified_base (75)..(75): gm
  modified_base (76)..(76): 2'O-Methyl Cytosine
  modified_base (77)..(77): gm
  modified_base (78)..(79): 2'O-Methyl Cytosine
  modified_base (80)..(80): gm
  modified_base (81)..(81): inverted deoxythymidine incorporated at the 3'  end
ccgcgcggagggguuucauaaucccguuugucguuuuuuuuuugcggcgacgguagauuaugggcagugugaccgcgccgc

SEQ ID NO: 84 - RNA, 42 nt, Artificial Sequence
  Aptamer
  modified_base (1)..(1): gm
  modified_base (3)..(4): gm
  modified_base (6)..(6): gm
  modified_base (9)..(10): gm
  modified_base (11)..(11): um
  modified_base (13)..(13): gm
  modified_base (14)..(14): 2'O-Methyl Adenosine
  modified_base (15)..(16): um
  modified_base (18)..(18): um
  modified_base (19)..(21): 2' Fluoro Guanosine
  modified_base (22)..(22): 2'O-Methyl Cytosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (31)..(31): 2'O-Methyl Cytosine
  modified_base (32)..(32): gm
  modified_base (34)..(34): gm
  modified_base (35)..(36): 2'O-Methyl Cytosine
  modified_base (37)..(37): gm
  modified_base (38)..(39): 2'O-Methyl Cytosine
  modified_base (40)..(40): gm
  modified_base (41)..(41): 2'O-Methyl Adenosine
  misc_feature (42)..(42): The 2'O-Methyl cytosine is attached  through the linker 1,3-propanediolspacer to 2'O-Methyl cytosine of SEQ ID NO: 407
  modified_base (42)..(42): 2'O-Methyl Cytosine
gcggcgacgguagauuaugggcagugugaccgcgccgccgac

SEQ ID NO: 85 - RNA, 38 nt, Artificial Sequence; identical to SEQ ID NO: 78
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  misc_feature (38)..(38): The 2'O-Methyl cytosine is attached  through the linker 1,3-propanediolspacer to 2'O-Methyl cytosine of another nucleotide sequence CXAC
  modified_base (38)..(38): 2'O-Methyl Cytosine

SEQ ID NO: 86 - RNA, 38 nt, Artificial Sequence; identical to SEQ ID NO: 78
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  misc_feature (38)..(38): The 2'O-Methyl cytosine is attached  through the linker Hexaethyleneglycol spacer to 2'O-Methyl cytosine of another nucleotide sequence CXAC
  modified_base (38)..(38): 2'O-Methyl Cytosine

SEQ ID NO: 87 - RNA, 47 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (39)..(43): 2'O-Methyl deoxyuridine linker
  modified_base (39)..(43): 2'O-Methyl deoxyuridine
  modified_base (44)..(44): 2'O-Methyl Cytosine
  modified_base (45)..(45): gm
  modified_base (46)..(46): 2'O-Methyl Adenosine
  misc_feature (47)..(47): The 2'O-Methyl cytosine is attached  through the linker 1,3-propanediolspacer to 2'O-Methyl cytosine of SEQ ID NO: 410
  modified_base (47)..(47): 2'O-Methyl Cytosine
gcggcgacgguagauuaugggcagugugaccgcgccgcuuuuucgac

SEQ ID NO: 88 - RNA, 52 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (39)..(48): 2'O-Methyl deoxyuridine linker
  modified_base (39)..(48): 2'O-Methyl deoxyuridine
  modified_base (49)..(49): 2'O-Methyl Cytosine
  modified_base (50)..(50): gm
  modified_base (51)..(51): 2'O-Methyl Adenosine
  modified_base (52)..(52): 2'O-Methyl Cytosine
gcggcgacgguagauuaugggcagugugaccgcgccgcuuuuuuuuuucgac

SEQ ID NO: 89 - RNA, 73 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(36): gm
  modified_base (37)..(37): 2'O-Methyl Cytosine
  modified_base (38)..(39): gm
  modified_base (40)..(40): 2'O-Methyl Cytosine
  modified_base (41)..(41): gm
  modified_base (42)..(42): 2'O-Methyl Adenosine
  modified_base (43)..(43): 2'O-Methyl Cytosine
  modified_base (44)..(45): gm
  modified_base (46)..(46): um
  modified_base (47)..(47): 2'O-Methyl Adenosine
  modified_base (48)..(48): gm
  modified_base (49)..(49): 2'O-Methyl Adenosine
  modified_base (50)..(51): um
  modified_base (52)..(52): 2'O-Methyl Adenosine
  modified_base (53)..(53): um
  modified_base (54)..(56): 2' Fluoro Guanosine
  modified_base (57)..(57): 2'O-Methyl Cytosine
  modified_base (58)..(58): 2'O-Methyl Adenosine
  modified_base (59)..(59): 2' Fluoro Guanosine
  modified_base (60)..(60): um
  modified_base (61)..(61): 2' Fluoro Guanosine
  modified_base (62)..(62): um
  modified_base (63)..(63): 2' Fluoro Guanosine
  modified_base (64)..(64): 2'O-Methyl Adenosine
  modified_base (65)..(66): 2'O-Methyl Cytosine
  modified_base (67)..(67): gm
  modified_base (68)..(68): 2'O-Methyl Cytosine
  modified_base (69)..(69): gm
  modified_base (70)..(71): 2'O-Methyl Cytosine
  modified_base (72)..(72): gm
  modified_base (73)..(73): inverted deoxythymidine incorporated at the 3'  end
  modified_base (73)..(73): 2'O-Methyl Cytosine
ccgcgcggagggguuucauaaucccguuugucggcgcggcgacgguagauuaugggcagugugaccgcgccgc

SEQ ID NO: 90 - RNA, 35 nt, Artificial Sequence; identical to SEQ ID NO: 67
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  misc_feature (35)..(35): The 2'O-Methyl cytosine is attached  through the linker 1,3-propanediolspacer to 2'O-Methyl guanosine of SEQ ID NO: 412
  modified_base (35)..(35): 2'O-Methyl Cytosine

SEQ ID NO: 91 - RNA, 35 nt, Artificial Sequence; identical to SEQ ID NO: 67
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  misc_feature (35)..(35): The 2'O-Methyl cytosine is attached through the linker Hexaethyleneglycol spacer to 2'O-Methyl guanosine of  SEQ ID NO: 413
  modified_base (35)..(35): 2'O-Methyl Cytosine

SEQ ID NO: 92 - RNA, 78 nt, Artificial Sequence
  Aptamer
  misc_feature (1)..(1): The 2'O-Methyl cytosine is attached  through the linker 1,3-propanediol to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (36)..(40): 2'O-Methyl deoxyuridine linker
  modified_base (36)..(40): 2'O-Methyl deoxyuridine
  modified_base (41)..(41): gm
  modified_base (42)..(42): 2'O-Methyl Cytosine
  modified_base (43)..(44): gm
  modified_base (45)..(45): 2'O-Methyl Cytosine
  modified_base (46)..(46): gm
  modified_base (47)..(47): 2'O-Methyl Adenosine
  modified_base (48)..(48): 2'O-Methyl Cytosine
  modified_base (49)..(50): gm
  modified_base (51)..(51): um
  modified_base (52)..(52): 2'O-Methyl Adenosine
  modified_base (53)..(53): gm
  modified_base (54)..(54): 2'O-Methyl Adenosine
  modified_base (55)..(56): um
  modified_base (57)..(57): 2'O-Methyl Adenosine
  modified_base (58)..(58): um
  modified_base (59)..(61): 2' Fluoro Guanosine
  modified_base (59)..(59): gm
  modified_base (60)..(61): gm
  modified_base (62)..(62): 2'O-Methyl Cytosine
  modified_base (63)..(63): 2'O-Methyl Adenosine
  modified_base (64)..(64): 2'O-Methyl Cytosine
  modified_base (64)..(64): 2' Fluoro Guanosine
  modified_base (64)..(64): gm
  modified_base (65)..(65): um
  modified_base (66)..(66): 2' Fluoro Guanosine
  modified_base (66)..(66): gm
  modified_base (67)..(67): um
  modified_base (68)..(68): 2' Fluoro Guanosine
  modified_base (68)..(68): gm
  modified_base (69)..(69): 2'O-Methyl Adenosine
  modified_base (70)..(71): 2'O-Methyl Cytosine
  modified_base (72)..(72): gm
  modified_base (73)..(73): 2'O-Methyl Cytosine
  modified_base (74)..(74): gm
  modified_base (75)..(76): 2'O-Methyl Cytosine
  modified_base (77)..(77): gm
  modified_base (78)..(78): inverted deoxythymidine incorporated at the 3'  end
  modified_base (78)..(78): 2'O-Methyl Cytosine
ccgcgcggagggguuucauaaucccguuugucggcuuuuugcggcgacgguagauuaugggcagugugaccgcgccgc

SEQ ID NO: 93 - RNA, 83 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (36)..(45): 2'O-Methyl deoxyuridine linker
  modified_base (36)..(45): 2'O-Methyl deoxyuridine
  modified_base (46)..(46): gm
  modified_base (47)..(47): 2'O-Methyl Cytosine
  modified_base (48)..(49): gm
  modified_base (50)..(50): 2'O-Methyl Cytosine
  modified_base (51)..(51): gm
  modified_base (52)..(52): 2'O-Methyl Adenosine
  modified_base (53)..(53): 2'O-Methyl Cytosine
  modified_base (54)..(55): gm
  modified_base (56)..(56): um
  modified_base (57)..(57): 2'O-Methyl Adenosine
  modified_base (58)..(58): gm
  modified_base (59)..(59): 2'O-Methyl Adenosine
  modified_base (60)..(61): um
  modified_base (62)..(62): 2'O-Methyl Adenosine
  modified_base (63)..(63): um
  modified_base (64)..(66): gm
  modified_base (67)..(67): 2'O-Methyl Cytosine
  modified_base (68)..(68): 2'O-Methyl Adenosine
  modified_base (69)..(69): gm
  modified_base (70)..(70): um
  modified_base (71)..(71): gm
  modified_base (72)..(72): um
  modified_base (73)..(73): gm
  modified_base (74)..(74): 2'O-Methyl Adenosine
  modified_base (75)..(76): 2'O-Methyl Cytosine
  modified_base (77)..(77): gm
  modified_base (78)..(78): 2'O-Methyl Cytosine
  modified_base (79)..(79): gm
  modified_base (80)..(81): 2'O-Methyl Cytosine
  modified_base (82)..(82): gm
  modified_base (83)..(83): inverted deoxythymidine incorporated at the 3'  end
  modified_base (83)..(83): 2'O-Methyl Cytosine
ccgcgcggagggguuucauaaucccguuugucggcuuuuuuuuuugcggcgacgguagauuaugggcagugugaccgcgccgc

SEQ ID NO: 94 - RNA, 44 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(9): gm
  modified_base (10)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  misc_feature (44)..(44): The 2'O-Methyl cytosine is attached  through the linker 1,3-propanediolspacer to 2'O-Methyl cytosine of SEQ ID NO: 414
  modified_base (44)..(44): 2'O-Methyl Cytosine
gcggcgacgguagauuaugggcagugugaccgcgccgcgccgac

SEQ ID NO: 95 - RNA, 38 nt, Artificial Sequence; identical to SEQ ID NO: 78
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  misc_feature (38)..(38): The 2'O-Methyl cytosine is attached  through the linker 1,3-propanediolspacer to 2'O-Methyl guanosine of another nucleotide sequence XCCXAC
  modified_base (38)..(38): 2'O-Methyl Cytosine

SEQ ID NO: 96 - RNA, 38 nt, Artificial Sequence; identical to SEQ ID NO: 78
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(9): gm
  modified_base (10)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  misc_feature (38)..(38): The 2'O-Methyl cytosine is attached  through the linker Hexaethyleneglycol spacer to 2'O-Methyl guanosine of another nucleotide sequence XCCXAC
  modified_base (38)..(38): 2'O-Methyl Cytosine

SEQ ID NO: 97 - RNA, 49 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (39)..(43): 2'O-Methyl deoxyuridine linker
  modified_base (39)..(43): 2'O-Methyl deoxyuridine
  modified_base (44)..(44): gm
  modified_base (45)..(46): 2'O-Methyl Cytosine
  modified_base (47)..(47): gm
  modified_base (48)..(48): 2'O-Methyl Adenosine
  misc_feature (49)..(49): The 2'O-Methyl cytosine is attached  through the linker 1,3-propanediolspacer to 2'O-Methyl cytosine of SEQ ID NO: 417
  modified_base (49)..(49): 2'O-Methyl Cytosine
gcggcgacgguagauuaugggcagugugaccgcgccgcuuuuugccgac

SEQ ID NO: 98 - RNA, 54 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (39)..(48): 2'O-Methyl deoxyuridine linker
  modified_base (39)..(48): 2'O-Methyl deoxyuridine
  modified_base (49)..(49): gm
  modified_base (50)..(51): 2'O-Methyl Cytosine
  modified_base (52)..(52): gm
  modified_base (53)..(53): 2'O-Methyl Adenosine
  misc_feature (54)..(54): The 2'O-Methyl cytosine is attached  through the linker 1,3-propanediolspacer to 2'O-Methyl cytosine of SEQ ID NO: 418
  modified_base (54)..(54): 2'O-Methyl Cytosine
gcggcgacgguagauuaugggcagugugaccgcgccgcuuuuuuuuuugccgac

SEQ ID NO: 99 - RNA, 36 nt, Artificial Sequence; identical to SEQ ID NO: 9
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(6): 2'O-Methyl Cytosine
  modified_base (7)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  misc_feature (36)..(36): inverted deoxythymidine incorporated at the 3'  end
  modified_base (36)..(36): gm

SEQ ID NO: 100 - RNA, 70 nt, Artificial Sequence
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(38): gm
  modified_base (39)..(39): 2'O-Methyl Cytosine
  modified_base (40)..(40): gm
  modified_base (41)..(41): 2'O-Methyl Adenosine
  modified_base (42)..(42): 2'O-Methyl Cytosine
  modified_base (43)..(44): gm
  modified_base (45)..(45): um
  modified_base (46)..(46): 2'O-Methyl Adenosine
  modified_base (47)..(47): gm
  modified_base (48)..(48): 2'O-Methyl Adenosine
  modified_base (49)..(50): um
  modified_base (51)..(51): 2'O-Methyl Adenosine
  modified_base (52)..(52): um
  modified_base (53)..(55): 2' Fluoro Guanosine
  modified_base (56)..(56): 2'O-Methyl Cytosine
  modified_base (57)..(57): 2'O-Methyl Adenosine
  modified_base (58)..(58): 2' Fluoro Guanosine
  modified_base (59)..(59): um
  modified_base (60)..(60): 2' Fluoro Guanosine
  modified_base (61)..(61): um
  modified_base (62)..(62): 2' Fluoro Guanosine
  modified_base (63)..(63): 2'O-Methyl Adenosine
  modified_base (64)..(64): 2'O-Methyl Cytosine
  modified_base (64)..(65): 2'O-Methyl Cytosine
  modified_base (66)..(66): gm
  modified_base (67)..(67): 2'O-Methyl Cytosine
  modified_base (68)..(68): gm
  modified_base (69)..(70): 2'O-Methyl Cytosine
  modified_base (70)..(70): inverted deoxythymidine incorporated at the 3'  end
cgacuccgcgcggaggcuugagguagccguuugucgggcgacgguagauuaugggcagugugaccgcgcc

SEQ ID NO: 101 - RNA, 36 nt, Artificial Sequence; identical to SEQ ID NO: 9
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  misc_feature (36)..(36): The 2'O-Methyl guanosine is attached  through the linker 1,3-propanediolspacer to 2'O-Methyl guanosine of SEQ ID NO: 419
  modified_base (36)..(36): gm

SEQ ID NO: 102 - RNA, 36 nt, Artificial Sequence; identical to SEQ ID NO: 9
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  misc_feature (36)..(36): The 2'O-Methyl guanosine is attached through the linker Hexaethyleneglycol spacer to 2'O-Methyl guanosine of  SEQ ID NO: 420
  modified_base (36)..(36): gm

SEQ ID NO: 103 - RNA, 75 nt, Artificial Sequence
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  misc_feature (37)..(41): 2'O-Methyl deoxyuridine linker
  modified_base (37)..(41): 2'O-Methyl deoxyuridine
  modified_base (42)..(43): gm
  modified_base (44)..(44): 2'O-Methyl Cytosine
  modified_base (45)..(45): gm
  modified_base (46)..(46): 2'O-Methyl Adenosine
  modified_base (47)..(47): 2'O-Methyl Cytosine
  modified_base (48)..(49): gm
  modified_base (50)..(50): um
  modified_base (51)..(51): 2'O-Methyl Adenosine
  modified_base (52)..(52): gm
  modified_base (53)..(53): 2'O-Methyl Adenosine
  modified_base (54)..(55): um
  modified_base (56)..(56): 2'O-Methyl Adenosine
  modified_base (57)..(57): um
  modified_base (58)..(60): 2' Fluoro Guanosine
  modified_base (61)..(61): 2'O-Methyl Cytosine
  modified_base (62)..(62): 2'O-Methyl Adenosine
  modified_base (63)..(63): 2' Fluoro Guanosine
  modified_base (64)..(64): um
  modified_base (65)..(65): 2' Fluoro Guanosine
  modified_base (66)..(66): um
  modified_base (67)..(67): 2' Fluoro Guanosine
  modified_base (68)..(68): 2'O-Methyl Adenosine
  modified_base (69)..(70): 2'O-Methyl Cytosine
  modified_base (71)..(71): gm
  modified_base (72)..(72): 2'O-Methyl Cytosine
  modified_base (73)..(73): gm
  modified_base (74)..(75): 2'O-Methyl Cytosine
  modified_base (75)..(75): inverted deoxythymidine incorporated at the 3'  end
cgacuccgcgcggaggcuugagguagccguuugucguuuuuggcgacgguagauuaugggcagugugaccgcgcc

SEQ ID NO: 104 - RNA, 80 nt, Artificial Sequence
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  misc_feature (37)..(46): 2'O-Methyl deoxyuridine linker
  modified_base (37)..(46): 2'O-Methyl deoxyuridine
  modified_base (47)..(48): gm
  modified_base (49)..(49): 2'O-Methyl Cytosine
  modified_base (50)..(50): gm
  modified_base (51)..(51): 2'O-Methyl Adenosine
  modified_base (52)..(52): 2'O-Methyl Cytosine
  modified_base (53)..(54): gm
  modified_base (55)..(55): um
  modified_base (56)..(56): 2'O-Methyl Adenosine
  modified_base (57)..(57): gm
  modified_base (58)..(58): 2'O-Methyl Adenosine
  modified_base (59)..(60): um
  modified_base (61)..(61): 2'O-Methyl Adenosine
  modified_base (62)..(62): um
  modified_base (63)..(65): 2' Fluoro Guanosine
  modified_base (66)..(66): 2'O-Methyl Cytosine
  modified_base (67)..(67): 2'O-Methyl Adenosine
  modified_base (68)..(68): 2' Fluoro Guanosine
  modified_base (69)..(69): um
  modified_base (70)..(70): 2' Fluoro Guanosine
  modified_base (71)..(71): um
  modified_base (72)..(72): 2' Fluoro Guanosine
  modified_base (73)..(73): 2'O-Methyl Adenosine
  modified_base (74)..(75): 2'O-Methyl Cytosine
  modified_base (76)..(76): gm
  modified_base (77)..(77): 2'O-Methyl Cytosine
  modified_base (78)..(78): gm
  modified_base (79)..(80): 2'O-Methyl Cytosine
  modified_base (80)..(80): inverted deoxythymidine incorporated at the 3'  end
cgacuccgcgcggaggcuugagguagccguuugucguuuuuuuuuuggcgacgguagauuaugggcagugugaccgcgcc

SEQ ID NO: 105 - RNA, 70 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(35): 2'O-Methyl Cytosine
  modified_base (36)..(36): gm
  modified_base (37)..(37): 2'O-Methyl Adenosine
  modified_base (38)..(38): 2'O-Methyl Cytosine
  modified_base (39)..(39): um
  modified_base (40)..(41): 2'O-Methyl Cytosine
  modified_base (42)..(42): 2' Fluoro Guanosine
  modified_base (43)..(43): 2'O-Methyl Cytosine
  modified_base (44)..(44): 2' Fluoro Guanosine
  modified_base (45)..(45): 2'O-Methyl Cytosine
  modified_base (46)..(47): 2' Fluoro Guanosine
  modified_base (48)..(48): 2'O-Methyl Adenosine
  modified_base (49)..(50): 2' Fluoro Guanosine
  modified_base (51)..(51): 2'O-Methyl Cytosine
  modified_base (52)..(53): um
  modified_base (54)..(54): 2' Fluoro Guanosine
  modified_base (55)..(55): 2'O-Methyl Adenosine
  modified_base (56)..(57): 2' Fluoro Guanosine
  modified_base (58)..(58): um
  modified_base (59)..(59): 2'O-Methyl Adenosine
  modified_base (60)..(60): 2' Fluoro Guanosine
  modified_base (61)..(62): 2'O-Methyl Cytosine
  modified_base (63)..(63): gm
  modified_base (64)..(66): um
  modified_base (67)..(67): gm
  modified_base (68)..(68): um
  modified_base (69)..(69): 2'O-Methyl Cytosine
  modified_base (70)..(70): inverted deoxythymidine incorporated at the 3'  end
  modified_base (70)..(70): gm
ggcgacgguagauuaugggcagugugaccgcgcccgacuccgcgcggaggcuugagguagccguuugucg

SEQ ID NO: 106 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker 1,3-propanediolspacer to 2'O-Methyl cytosine of SEQ ID NO: 421
  misc_feature (34)..(34): The 2'O-Methyl cytosine is attached through the linker Hexaethyleneglycol spacer to 2'O-Methyl cytosine of SEQ ID NO: 422

SEQ ID NO: 107 - RNA, 75 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(39): 2'O-Methyl deoxyuridine linker
  modified_base (35)..(39): 2'O-Methyl deoxyuridine
  modified_base (40)..(40): 2'O-Methyl Cytosine
  modified_base (41)..(41): gm
  modified_base (42)..(42): 2'O-Methyl Adenosine
  modified_base (43)..(43): 2'O-Methyl Cytosine
  modified_base (44)..(44): um
  modified_base (45)..(46): 2'O-Methyl Cytosine
  modified_base (47)..(47): 2' Fluoro Guanosine
  modified_base (48)..(48): 2'O-Methyl Cytosine
  modified_base (49)..(49): 2' Fluoro Guanosine
  modified_base (50)..(50): 2'O-Methyl Cytosine
  modified_base (51)..(52): 2' Fluoro Guanosine
  modified_base (53)..(53): 2'O-Methyl Adenosine
  modified_base (54)..(55): 2' Fluoro Guanosine
  modified_base (56)..(56): 2'O-Methyl Cytosine
  modified_base (57)..(58): um
  modified_base (59)..(59): 2' Fluoro Guanosine
  modified_base (60)..(60): 2'O-Methyl Adenosine
  modified_base (61)..(62): 2' Fluoro Guanosine
  modified_base (63)..(63): um
  modified_base (64)..(64): 2'O-Methyl Adenosine
  modified_base (65)..(65): 2' Fluoro Guanosine
  modified_base (66)..(67): 2'O-Methyl Cytosine
  modified_base (68)..(68): 2' Fluoro Guanosine
  modified_base (69)..(71): um
  modified_base (72)..(72): gm
  modified_base (73)..(73): um
  modified_base (74)..(74): 2'O-Methyl Cytosine
  misc_feature (75)..(75): inverted deoxythymidine incorporated at the 3'  end
  modified_base (75)..(75): gm
ggcgacgguagauuaugggcagugugaccgcgccuuuuucgacuccgcgcggaggcuugagguagccguuugucg

SEQ ID NO: 108 - RNA, 80 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(44): 2'O-Methyl deoxyuridine linker
  modified_base (35)..(44): 2'O-Methyl deoxyuridine
  modified_base (45)..(45): 2'O-Methyl Cytosine
  modified_base (46)..(46): gm
  modified_base (47)..(47): 2'O-Methyl Adenosine
  modified_base (48)..(48): 2'O-Methyl Cytosine
  modified_base (49)..(49): um
  modified_base (50)..(51): 2'O-Methyl Cytosine
  modified_base (52)..(52): 2' Fluoro Guanosine
  modified_base (53)..(53): 2'O-Methyl Cytosine
  modified_base (54)..(54): 2' Fluoro Guanosine
  modified_base (55)..(55): 2'O-Methyl Cytosine
  modified_base (56)..(57): 2' Fluoro Guanosine
  modified_base (58)..(58): 2'O-Methyl Adenosine
  modified_base (59)..(60): 2' Fluoro Guanosine
  modified_base (61)..(61): 2'O-Methyl Cytosine
  modified_base (62)..(63): um
  modified_base (64)..(64): 2' Fluoro Guanosine
  modified_base (65)..(65): 2'O-Methyl Adenosine
  modified_base (66)..(67): 2' Fluoro Guanosine
  modified_base (68)..(68): um
  modified_base (69)..(69): 2'O-Methyl Adenosine
  modified_base (70)..(70): 2' Fluoro Guanosine
  modified_base (71)..(72): 2'O-Methyl Cytosine
  modified_base (73)..(73): 2' Fluoro Guanosine
  modified_base (74)..(76): um
  modified_base (77)..(77): gm
  modified_base (78)..(78): um
  modified_base (79)..(79): 2'O-Methyl Cytosine
  modified_base (80)..(80): inverted deoxythymidine incorporated at the 3'  end
  modified_base (80)..(80): gm
ggcgacgguagauuaugggcagugugaccgcgccuuuuuuuuuucgacuccgcgcggaggcuugagguagccguuugucg

SEQ ID NO: 109 - RNA, 70 nt, Artificial Sequence; identical to SEQ ID NO: 105
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(35): 2'O-Methyl Cytosine
  modified_base (36)..(36): gm
  modified_base (37)..(37): 2'O-Methyl Adenosine
  modified_base (38)..(38): 2'O-Methyl Cytosine
  modified_base (39)..(39): um
  modified_base (40)..(41): 2'O-Methyl Cytosine
  modified_base (42)..(42): 2' Fluoro Guanosine
  modified_base (43)..(43): 2'O-Methyl Cytosine
  modified_base (44)..(44): 2' Fluoro Guanosine
  modified_base (45)..(45): 2'O-Methyl Cytosine
  modified_base (46)..(47): 2' Fluoro Guanosine
  modified_base (48)..(48): 2'O-Methyl Adenosine
  modified_base (49)..(50): 2' Fluoro Guanosine
  modified_base (51)..(51): 2'O-Methyl Cytosine
  modified_base (52)..(53): um
  modified_base (54)..(54): 2' Fluoro Guanosine
  modified_base (55)..(55): 2'O-Methyl Adenosine
  modified_base (56)..(57): 2' Fluoro Guanosine
  modified_base (58)..(58): um
  modified_base (59)..(59): 2'O-Methyl Adenosine
  modified_base (60)..(60): 2' Fluoro Guanosine
  modified_base (61)..(62): 2'O-Methyl Cytosine
  modified_base (63)..(63): gm
  modified_base (64)..(66): um
  modified_base (67)..(67): gm
  modified_base (68)..(68): um
  modified_base (69)..(69): 2'O-Methyl Cytosine
  modified_base (70)..(70): inverted deoxythymidine incorporated at the 3'  end
  modified_base (70)..(70): gm

SEQ ID NO: 110 - RNA, 40 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): inverted deoxythymidine incorporated at the 3'  end
  modified_base (40)..(40): 2'O-Methyl Cytosine
gccgacuccgcgcggaggcuugagguagccguuugucggc

SEQ ID NO: 111 - RNA, 74 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(42): gm
  modified_base (43)..(43): 2'O-Methyl Cytosine
  modified_base (44)..(44): gm
  modified_base (45)..(45): 2'O-Methyl Adenosine
  modified_base (46)..(46): 2'O-Methyl Cytosine
  modified_base (47)..(48): gm
  modified_base (49)..(49): um
  modified_base (50)..(50): 2'O-Methyl Adenosine
  modified_base (51)..(51): gm
  modified_base (52)..(52): 2'O-Methyl Adenosine
  modified_base (53)..(54): um
  modified_base (55)..(55): 2'O-Methyl Adenosine
  modified_base (56)..(56): um
  modified_base (57)..(59): 2' Fluoro Guanosine
  modified_base (60)..(60): 2'O-Methyl Cytosine
  modified_base (61)..(61): 2'O-Methyl Adenosine
  modified_base (62)..(62): 2' Fluoro Guanosine
  modified_base (63)..(63): um
  modified_base (64)..(64): 2' Fluoro Guanosine
  modified_base (65)..(65): um
  modified_base (66)..(66): 2' Fluoro Guanosine
  modified_base (67)..(67): 2'O-Methyl Adenosine
  modified_base (68)..(69): 2'O-Methyl Cytosine
  modified_base (70)..(70): gm
  modified_base (71)..(71): 2'O-Methyl Cytosine
  modified_base (72)..(72): gm
  modified_base (73)..(74): 2'O-Methyl Cytosine
  modified_base (74)..(74): inverted deoxythymidine incorporated at the 3'  end
gccgacuccgcgcggaggcuugagguagccguuugucggcggcgacgguagauuaugggcagugugaccgcgcc

SEQ ID NO: 112 - RNA, 40 nt, Artificial Sequence; identical to SEQ ID NO: 110
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  misc_feature (40)..(40): The 2'O-Methyl cytosine is attached  through the linker 1,3-propanediolspacer to 2'O-Methyl guanosine of SEQ ID NO: 423
  modified_base (40)..(40): 2'O-Methyl Cytosine

SEQ ID NO: 113 - RNA, 40 nt, Artificial Sequence; identical to SEQ ID NO: 110
  Aptamer
  modified_base (2)..(3): 2'O-Methyl Cytosine
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): 2' Fluoro Guanosine
  modified_base (36)..(36): um
  modified_base (37)..(37): 2'O-Methyl Cytosine
  modified_base (38)..(39): 2' Fluoro Guanosine
  misc_feature (40)..(40): The 2'O-Methyl cytosine is attached through the linker hexaethylene glycol spacer to 2'O-Methyl guanosine of SEQ ID NO:424
  modified_base (40)..(40): 2'O-Methyl Cytosine

SEQ ID NO: 114 - RNA, 79 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  misc_feature (41)..(45): 2'O-Methyl deoxyuridine linker
  modified_base (41)..(45): 2'O-Methyl deoxyuridine
  modified_base (46)..(47): gm
  modified_base (48)..(48): 2'O-Methyl Cytosine
  modified_base (49)..(49): gm
  modified_base (50)..(50): 2'O-Methyl Adenosine
  modified_base (51)..(51): 2'O-Methyl Cytosine
  modified_base (52)..(53): gm
  modified_base (54)..(54): um
  modified_base (55)..(55): 2'O-Methyl Adenosine
  modified_base (56)..(56): gm
  modified_base (57)..(57): 2'O-Methyl Adenosine
  modified_base (58)..(59): um
  modified_base (60)..(60): 2'O-Methyl Adenosine
  modified_base (61)..(61): um
  modified_base (62)..(64): 2' Fluoro Guanosine
  modified_base (65)..(65): 2'O-Methyl Cytosine
  modified_base (66)..(66): 2'O-Methyl Adenosine
  modified_base (67)..(67): 2' Fluoro Guanosine
  modified_base (68)..(68): um
  modified_base (69)..(69): 2' Fluoro Guanosine
  modified_base (70)..(70): um
  modified_base (71)..(71): 2' Fluoro Guanosine
  modified_base (72)..(72): 2'O-Methyl Adenosine
  modified_base (73)..(74): 2'O-Methyl Cytosine
  modified_base (75)..(75): gm
  modified_base (76)..(76): 2'O-Methyl Cytosine
  modified_base (77)..(77): gm
  modified_base (78)..(79): 2'O-Methyl Cytosine
  misc_feature (79)..(79): inverted deoxythymidine incorporated at the 3'  end
gccgacuccgcgcggaggcuugagguagccguuugucggcuuuuuggcgacgguagauuaugggcagugugaccgcgcc

SEQ ID NO: 115 - RNA, 84 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  misc_feature (41)..(50): 2'O-Methyl deoxyuridine linker
  modified_base (41)..(50): 2'O-Methyl deoxyuridine
  modified_base (51)..(52): gm
  modified_base (53)..(53): 2'O-Methyl Cytosine
  modified_base (54)..(54): gm
  modified_base (55)..(55): 2'O-Methyl Adenosine
  modified_base (56)..(56): 2'O-Methyl Cytosine
  modified_base (57)..(58): gm
  modified_base (59)..(59): um
  modified_base (60)..(60): 2'O-Methyl Adenosine
  modified_base (61)..(61): gm
  modified_base (62)..(62): 2'O-Methyl Adenosine
  modified_base (63)..(64): um
  modified_base (65)..(65): 2'O-Methyl Adenosine
  modified_base (66)..(66): um
  modified_base (67)..(69): 2' Fluoro Guanosine
  modified_base (70)..(70): 2'O-Methyl Cytosine
  modified_base (71)..(71): 2'O-Methyl Adenosine
  modified_base (72)..(72): 2' Fluoro Guanosine
  modified_base (73)..(73): um
  modified_base (74)..(74): 2' Fluoro Guanosine
  modified_base (75)..(75): um
  modified_base (76)..(76): 2' Fluoro Guanosine
  modified_base (77)..(77): 2'O-Methyl Adenosine
  modified_base (78)..(79): 2'O-Methyl Cytosine
  modified_base (80)..(80): gm
  modified_base (81)..(81): 2'O-Methyl Cytosine
  modified_base (82)..(82): gm
  modified_base (83)..(84): 2'O-Methyl Cytosine
  modified_base (84)..(84): inverted deoxythymidine incorporated at the 3'  end
gccgacuccgcgcggaggcuugagguagccguuugucggcuuuuuuuuuuggcgacgguagauuaugggcagugugaccgcgcc

SEQ ID NO: 116 - RNA, 74 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(35): gm
  modified_base (36)..(37): 2'O-Methyl Cytosine
  modified_base (38)..(38): gm
  modified_base (39)..(39): 2'O-Methyl Adenosine
  modified_base (40)..(40): 2'O-Methyl Cytosine
  modified_base (41)..(41): um
  modified_base (42)..(43): 2'O-Methyl Cytosine
  modified_base (44)..(44): 2' Fluoro Guanosine
  modified_base (45)..(45): 2'O-Methyl Cytosine
  modified_base (46)..(46): 2' Fluoro Guanosine
  modified_base (47)..(47): 2'O-Methyl Cytosine
  modified_base (48)..(49): 2' Fluoro Guanosine
  modified_base (50)..(50): 2'O-Methyl Adenosine
  modified_base (51)..(52): 2' Fluoro Guanosine
  modified_base (53)..(53): 2'O-Methyl Cytosine
  modified_base (54)..(55): um
  modified_base (56)..(56): 2' Fluoro Guanosine
  modified_base (57)..(57): 2'O-Methyl Adenosine
  modified_base (58)..(59): 2' Fluoro Guanosine
  modified_base (60)..(60): um
  modified_base (61)..(61): 2'O-Methyl Adenosine
  modified_base (62)..(62): 2' Fluoro Guanosine
  modified_base (63)..(64): 2'O-Methyl Cytosine
  modified_base (65)..(65): 2' Fluoro Guanosine
  modified_base (66)..(68): um
  modified_base (69)..(69): gm
  modified_base (70)..(70): um
  modified_base (71)..(71): 2'O-Methyl Cytosine
  modified_base (72)..(73): gm
  modified_base (74)..(74): inverted deoxythymidine incorporated at the 3'  end
  modified_base (74)..(74): 2'O-Methyl Cytosine
ggcgacgguagauuaugggcagugugaccgcgccgccgacuccgcgcggaggcuugagguagccguuugucggc

SEQ ID NO: 117 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker 1,3-propanediolspacer to 2'O-Methyl guanosine of SEQ ID NO: 425

SEQ ID NO: 118 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached through the linker hexaethylene glycol spacer to 2'O-Methyl guanosine of SEQ ID NO:426

SEQ ID NO: 119 - RNA, 79 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(39): 2'O-Methyl deoxyuridine linker
  modified_base (35)..(39): 2'O-Methyl deoxyuridine
  modified_base (40)..(40): gm
  modified_base (41)..(42): 2'O-Methyl Cytosine
  modified_base (43)..(43): gm
  modified_base (44)..(44): 2'O-Methyl Adenosine
  modified_base (45)..(45): 2'O-Methyl Cytosine
  modified_base (46)..(46): um
  modified_base (47)..(48): 2'O-Methyl Cytosine
  modified_base (49)..(49): 2' Fluoro Guanosine
  modified_base (50)..(50): 2'O-Methyl Cytosine
  modified_base (51)..(51): 2' Fluoro Guanosine
  modified_base (52)..(52): 2'O-Methyl Cytosine
  modified_base (53)..(54): 2' Fluoro Guanosine
  modified_base (55)..(55): 2'O-Methyl Adenosine
  modified_base (56)..(57): 2' Fluoro Guanosine
  modified_base (58)..(58): 2'O-Methyl Cytosine
  modified_base (59)..(60): um
  modified_base (61)..(61): 2' Fluoro Guanosine
  modified_base (62)..(62): 2'O-Methyl Adenosine
  modified_base (63)..(64): 2' Fluoro Guanosine
  modified_base (65)..(65): um
  modified_base (66)..(66): 2'O-Methyl Adenosine
  modified_base (67)..(67): 2' Fluoro Guanosine
  modified_base (68)..(68): 2'O-Methyl Cytosine
  modified_base (69)..(69): 2'O-Methyl Cytosine
  modified_base (70)..(70): 2' Fluoro Guanosine
  modified_base (71)..(73): um
  modified_base (74)..(74): gm
  modified_base (75)..(75): um
  modified_base (76)..(76): 2'O-Methyl Cytosine
  modified_base (77)..(78): gm
  modified_base (79)..(79): inverted deoxythymidine incorporated at the 3'  end
  modified_base (79)..(79): 2'O-Methyl Cytosine
ggcgacgguagauuaugggcagugugaccgcgccuuuuugccgacuccgcgcggaggcuugagguagccguuugucggc

SEQ ID NO: 120 - RNA, 84 nt, Artificial Sequence
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(44): 2'O-Methyl deoxyuridine linker
  modified_base (35)..(44): 2'O-Methyl deoxyuridine
  modified_base (45)..(45): gm
  modified_base (46)..(47): 2'O-Methyl Cytosine
  modified_base (48)..(48): gm
  modified_base (49)..(49): 2'O-Methyl Adenosine
  modified_base (50)..(50): 2'O-Methyl Cytosine
  modified_base (51)..(51): um
  modified_base (52)..(53): 2'O-Methyl Cytosine
  modified_base (54)..(54): 2' Fluoro Guanosine
  modified_base (55)..(55): 2'O-Methyl Cytosine
  modified_base (56)..(56): 2' Fluoro Guanosine
  modified_base (57)..(57): 2'O-Methyl Cytosine
  modified_base (58)..(59): 2' Fluoro Guanosine
  modified_base (60)..(60): 2'O-Methyl Adenosine
  modified_base (61)..(62): 2' Fluoro Guanosine
  modified_base (63)..(63): 2'O-Methyl Cytosine
  modified_base (64)..(65): um
  modified_base (66)..(66): 2' Fluoro Guanosine
  modified_base (67)..(67): 2'O-Methyl Adenosine
  modified_base (68)..(69): 2' Fluoro Guanosine
  modified_base (70)..(70): um
  modified_base (71)..(71): 2'O-Methyl Adenosine
  modified_base (72)..(72): 2' Fluoro Guanosine
  modified_base (73)..(74): 2'O-Methyl Cytosine
  modified_base (75)..(75): 2' Fluoro Guanosine
  modified_base (76)..(78): um
  modified_base (79)..(79): gm
  modified_base (80)..(80): um
  modified_base (81)..(81): 2'O-Methyl Cytosine
  modified_base (82)..(83): gm
  modified_base (84)..(84): inverted deoxythymidine incorporated at the 3'  end
  modified_base (84)..(84): 2'O-Methyl Cytosine
ggcgacgguagauuaugggcagugugaccgcgccuuuuuuuuuugccgacuccgcgcggaggcuugagguagccguuugucggc

SEQ ID NO: 121 - RNA, 74 nt, Artificial Sequence
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(6): 2'O-Methyl Cytosine
  modified_base (7)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(37): gm
  modified_base (38)..(38): 2'O-Methyl Cytosine
  modified_base (39)..(40): gm
  modified_base (41)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(46): gm
  modified_base (47)..(47): um
  modified_base (48)..(48): 2'O-Methyl Adenosine
  modified_base (49)..(49): gm
  modified_base (50)..(50): 2'O-Methyl Adenosine
  modified_base (51)..(52): um
  modified_base (53)..(53): 2'O-Methyl Adenosine
  modified_base (54)..(54): um
  modified_base (55)..(57): 2' Fluoro Guanosine
  modified_base (58)..(58): 2'O-Methyl Cytosine
  modified_base (59)..(59): 2'O-Methyl Adenosine
  modified_base (60)..(60): 2' Fluoro Guanosine
  modified_base (61)..(61): um
  modified_base (62)..(62): 2' Fluoro Guanosine
  modified_base (63)..(63): um
  modified_base (64)..(64): 2' Fluoro Guanosine
  modified_base (65)..(65): 2'O-Methyl Adenosine
  modified_base (66)..(67): 2'O-Methyl Cytosine
  modified_base (68)..(68): gm
  modified_base (69)..(69): 2'O-Methyl Cytosine
  modified_base (70)..(70): gm
  modified_base (71)..(72): 2'O-Methyl Cytosine
  modified_base (73)..(73): gm
  modified_base (74)..(74): inverted deoxythymidine incorporated at the 3'  end
  modified_base (74)..(74): 2'O-Methyl Cytosine
cgacuccgcgcggaggcuugagguagccguuugucggcggcgacgguagauuaugggcagugugaccgcgccgc

SEQ ID NO: 122 - RNA, 36 nt, Artificial Sequence; identical to SEQ ID NO: 9
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  misc_feature (36)..(36): The 2'O-Methyl guanosine is attached  through the linker 1,3-propanediolspacer to 2'O-Methyl guanosine of SEQ ID NO: 427
  modified_base (36)..(36): gm

SEQ ID NO: 123 - RNA, 36 nt, Artificial Sequence; identical to SEQ ID NO: 9
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  misc_feature (36)..(36): The 2'O-Methyl cytosine is attached through the linker hexaethylene glycol spacer to 2'O-Methyl guanosine of SEQ ID NO:428
  modified_base (36)..(36): gm

SEQ ID NO: 124 - RNA, 79 nt, Artificial Sequence
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  misc_feature (37)..(41): 2'O-Methyl deoxyuridine linker
  modified_base (37)..(41): 2'O-Methyl deoxyuridine
  modified_base (42)..(42): gm
  modified_base (43)..(43): 2'O-Methyl Cytosine
  modified_base (44)..(45): gm
  modified_base (46)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  modified_base (50)..(51): gm
  modified_base (52)..(52): um
  modified_base (53)..(53): 2'O-Methyl Adenosine
  modified_base (54)..(54): gm
  modified_base (55)..(55): 2'O-Methyl Adenosine
  modified_base (56)..(57): um
  modified_base (58)..(58): 2'O-Methyl Adenosine
  modified_base (59)..(59): um
  modified_base (60)..(62): 2' Fluoro Guanosine
  modified_base (63)..(63): 2'O-Methyl Cytosine
  modified_base (64)..(64): 2'O-Methyl Adenosine
  modified_base (65)..(65): 2' Fluoro Guanosine
  modified_base (66)..(66): um
  modified_base (67)..(67): 2' Fluoro Guanosine
  modified_base (68)..(68): um
  modified_base (69)..(69): 2' Fluoro Guanosine
  modified_base (70)..(70): 2'O-Methyl Adenosine
  modified_base (71)..(72): 2'O-Methyl Cytosine
  modified_base (73)..(73): gm
  modified_base (74)..(74): 2'O-Methyl Cytosine
  modified_base (75)..(75): gm
  modified_base (76)..(77): 2'O-Methyl Cytosine
  modified_base (78)..(78): gm
  modified_base (79)..(79): inverted deoxythymidine incorporated at the 3'  end
  modified_base (79)..(79): 2'O-Methyl Cytosine
cgacuccgcgcggaggcuugagguagccguuugucguuuuugcggcgacgguagauuaugggcagugugaccgcgccgc

SEQ ID NO: 125 - RNA, 84 nt, Artificial Sequence
  Aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  misc_feature (37)..(46): 2'O-Methyl deoxyuridine linker
  modified_base (37)..(46): 2'O-Methyl deoxyuridine
  modified_base (47)..(47): gm
  modified_base (48)..(48): 2'O-Methyl Cytosine
  modified_base (49)..(50): gm
  modified_base (51)..(51): 2'O-Methyl Cytosine
  modified_base (52)..(52): gm
  modified_base (53)..(53): 2'O-Methyl Adenosine
  modified_base (54)..(54): 2'O-Methyl Cytosine
  modified_base (55)..(56): gm
  modified_base (57)..(57): um
  modified_base (58)..(58): 2'O-Methyl Adenosine
  modified_base (59)..(59): gm
  modified_base (60)..(60): 2'O-Methyl Adenosine
  modified_base (61)..(62): um
  modified_base (63)..(63): 2'O-Methyl Adenosine
  modified_base (64)..(64): um
  modified_base (65)..(67): 2' Fluoro Guanosine
  modified_base (68)..(68): 2'O-Methyl Cytosine
  modified_base (69)..(69): 2'O-Methyl Adenosine
  modified_base (70)..(70): 2' Fluoro Guanosine
  modified_base (71)..(71): um
  modified_base (72)..(72): 2' Fluoro Guanosine
  modified_base (73)..(73): um
  modified_base (74)..(74): 2' Fluoro Guanosine
  modified_base (75)..(75): 2'O-Methyl Adenosine
  modified_base (76)..(77): 2'O-Methyl Cytosine
  modified_base (78)..(78): gm
  modified_base (79)..(79): 2'O-Methyl Cytosine
  modified_base (80)..(80): gm
  modified_base (81)..(82): 2'O-Methyl Cytosine
  modified_base (83)..(83): gm
  modified_base (84)..(84): inverted deoxythymidine incorporated at the 3'  end
  modified_base (84)..(84): 2'O-Methyl Cytosine
cgacuccgcgcggaggcuugagguagccguuugucguuuuuuuuuugcggcgacgguagauuaugggcagugugaccgcgccgc

SEQ ID NO: 126 - RNA, 74 nt, Artificial Sequence; identical to SEQ ID NO: 116
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(35): gm
  modified_base (36)..(37): 2'O-Methyl Cytosine
  modified_base (38)..(38): gm
  modified_base (39)..(39): 2'O-Methyl Adenosine
  modified_base (40)..(40): 2'O-Methyl Cytosine
  modified_base (41)..(41): um
  modified_base (42)..(43): 2'O-Methyl Cytosine
  modified_base (44)..(44): 2' Fluoro Guanosine
  modified_base (45)..(45): 2'O-Methyl Cytosine
  modified_base (46)..(46): 2' Fluoro Guanosine
  modified_base (47)..(47): 2'O-Methyl Cytosine
  modified_base (48)..(49): 2' Fluoro Guanosine
  modified_base (50)..(50): 2'O-Methyl Adenosine
  modified_base (51)..(52): 2' Fluoro Guanosine
  modified_base (53)..(53): 2'O-Methyl Cytosine
  modified_base (54)..(55): um
  modified_base (56)..(56): 2' Fluoro Guanosine
  modified_base (57)..(57): 2'O-Methyl Adenosine
  modified_base (58)..(59): 2' Fluoro Guanosine
  modified_base (60)..(60): um
  modified_base (61)..(61): 2'O-Methyl Adenosine
  modified_base (62)..(62): 2' Fluoro Guanosine
  modified_base (63)..(64): 2'O-Methyl Cytosine
  modified_base (65)..(65): 2' Fluoro Guanosine
  modified_base (66)..(68): um
  modified_base (69)..(69): gm
  modified_base (70)..(70): um
  modified_base (71)..(71): 2'O-Methyl Cytosine
  modified_base (72)..(73): gm
  modified_base (74)..(74): inverted deoxythymidine incorporated at the 3'  end
  modified_base (74)..(74): 2'O-Methyl Cytosine

SEQ ID NO: 127 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker 1,3-propanediolspacer to 2'O-Methyl guanosine of SEQ ID NO: 429

SEQ ID NO: 128 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached through the linker hexaethylene glycol spacer to 2'O-Methyl guanosine of SEQ ID NO:430

SEQ ID NO: 129 - RNA, 79 nt, Artificial Sequence; identical to SEQ ID NO: 119
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(39): 2'O-Methyl deoxyuridine linker
  modified_base (35)..(39): 2'O-Methyl deoxyuridine
  modified_base (40)..(40): gm
  modified_base (41)..(42): 2'O-Methyl Cytosine
  modified_base (43)..(43): gm
  modified_base (44)..(44): 2'O-Methyl Adenosine
  modified_base (45)..(45): 2'O-Methyl Cytosine
  modified_base (46)..(46): um
  modified_base (47)..(48): 2'O-Methyl Cytosine
  modified_base (49)..(49): 2' Fluoro Guanosine
  modified_base (50)..(50): 2'O-Methyl Cytosine
  modified_base (51)..(51): 2' Fluoro Guanosine
  modified_base (52)..(52): 2'O-Methyl Cytosine
  modified_base (53)..(54): 2' Fluoro Guanosine
  modified_base (55)..(55): 2'O-Methyl Adenosine
  modified_base (56)..(57): 2' Fluoro Guanosine
  modified_base (58)..(58): 2'O-Methyl Cytosine
  modified_base (59)..(60): um
  modified_base (61)..(61): 2' Fluoro Guanosine
  modified_base (62)..(62): 2'O-Methyl Adenosine
  modified_base (63)..(64): 2' Fluoro Guanosine
  modified_base (65)..(65): um
  modified_base (66)..(66): 2'O-Methyl Adenosine
  modified_base (67)..(67): 2' Fluoro Guanosine
  modified_base (68)..(69): 2'O-Methyl Cytosine
  modified_base (70)..(70): 2' Fluoro Guanosine
  modified_base (71)..(73): um
  modified_base (74)..(74): gm
  modified_base (75)..(75): um
  modified_base (76)..(76): 2'O-Methyl Cytosine
  modified_base (77)..(78): gm
  modified_base (79)..(79): inverted deoxythymidine incorporated at the 3'  end
  modified_base (79)..(79): 2'O-Methyl Cytosine

SEQ ID NO: 130 - RNA, 84 nt, Artificial Sequence; identical to SEQ ID NO: 120
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (35)..(44): 2'O-Methyl deoxyuridine linker
  modified_base (35)..(44): 2'O-Methyl deoxyuridine
  modified_base (45)..(45): gm
  modified_base (46)..(47): 2'O-Methyl Cytosine
  modified_base (48)..(48): gm
  modified_base (49)..(49): 2'O-Methyl Adenosine
  modified_base (50)..(50): 2'O-Methyl Cytosine
  modified_base (51)..(51): um
  modified_base (52)..(53): 2'O-Methyl Cytosine
  modified_base (54)..(54): 2' Fluoro Guanosine
  modified_base (55)..(55): 2'O-Methyl Cytosine
  modified_base (56)..(56): 2' Fluoro Guanosine
  modified_base (57)..(57): 2'O-Methyl Cytosine
  modified_base (58)..(59): 2' Fluoro Guanosine
  modified_base (60)..(60): 2'O-Methyl Adenosine
  modified_base (61)..(62): 2' Fluoro Guanosine
  modified_base (63)..(63): 2'O-Methyl Cytosine
  modified_base (64)..(65): um
  modified_base (66)..(66): 2' Fluoro Guanosine
  modified_base (67)..(67): 2'O-Methyl Adenosine
  modified_base (68)..(69): 2' Fluoro Guanosine
  modified_base (70)..(70): um
  modified_base (71)..(71): 2'O-Methyl Adenosine
  modified_base (72)..(72): 2' Fluoro Guanosine
  modified_base (73)..(74): 2'O-Methyl Cytosine
  modified_base (75)..(75): 2' Fluoro Guanosine
  modified_base (76)..(78): um
  modified_base (79)..(79): gm
  modified_base (80)..(80): um
  modified_base (81)..(81): 2'O-Methyl Cytosine
  modified_base (82)..(83): gm
  modified_base (84)..(84): inverted deoxythymidine incorporated at the 3'  end
  modified_base (84)..(84): 2'O-Methyl Cytosine

SEQ ID NO: 131 - RNA, 78 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(41): gm
  modified_base (42)..(42): 2'O-Methyl Cytosine
  modified_base (43)..(44): gm
  modified_base (45)..(45): 2'O-Methyl Cytosine
  modified_base (46)..(46): gm
  modified_base (47)..(47): 2'O-Methyl Adenosine
  modified_base (48)..(48): 2'O-Methyl Cytosine
  modified_base (49)..(50): gm
  modified_base (51)..(51): um
  modified_base (52)..(52): 2'O-Methyl Adenosine
  modified_base (53)..(53): gm
  modified_base (54)..(54): 2'O-Methyl Adenosine
  modified_base (55)..(56): um
  modified_base (57)..(57): 2'O-Methyl Adenosine
  modified_base (58)..(58): um
  modified_base (59)..(61): 2' Fluoro Guanosine
  modified_base (62)..(62): 2'O-Methyl Cytosine
  modified_base (63)..(63): 2'O-Methyl Adenosine
  modified_base (64)..(64): 2' Fluoro Guanosine
  modified_base (65)..(65): um
  modified_base (66)..(66): 2' Fluoro Guanosine
  modified_base (67)..(67): um
  modified_base (68)..(68): 2' Fluoro Guanosine
  modified_base (69)..(69): 2'O-Methyl Adenosine
  modified_base (70)..(71): 2'O-Methyl Cytosine
  modified_base (72)..(72): gm
  modified_base (73)..(73): 2'O-Methyl Cytosine
  modified_base (74)..(74): gm
  modified_base (75)..(76): 2'O-Methyl Cytosine
  modified_base (77)..(77): gm
  modified_base (78)..(78): inverted deoxythymidine incorporated at the 3'  end
  modified_base (78)..(78): 2'O-Methyl Cytosine
gccgacuccgcgcggaggcuugagguagccguuugucggcgcggcgacgguagauuaugggcagugugaccgcgccgc

SEQ ID NO: 132 - RNA, 40 nt, Artificial Sequence; identical to SEQ ID NO: 110
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  misc_feature (40)..(40): The 2'O-Methyl cytosine is attached  through the linker 1,3-propanediolspacer to 2'O-Methyl guanosine of SEQ ID NO: 431
  modified_base (40)..(40): 2'O-Methyl Cytosine

SEQ ID NO: 133 - RNA, 40 nt, Artificial Sequence; identical to SEQ ID NO: 110
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (32)..(34): um
  modified_base (33)..(33): 2' Fluoro Guanosine
  modified_base (35)..(35): gm
  modified_base (36)..(36): um
  modified_base (37)..(37): 2'O-Methyl Cytosine
  modified_base (38)..(39): gm
  modified_base (40)..(40): The 2'O-Methyl cytosine is attached through the linker hexaethylene glycol spacer to 2'O-Methyl guanosine of SEQ ID NO:432
  modified_base (40)..(40): 2'O-Methyl Cytosine

SEQ ID NO: 134 - RNA, 83 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  misc_feature (41)..(45): 2'O-Methyl deoxyuridine linker
  modified_base (41)..(45): 2'O-Methyl deoxyuridine
  modified_base (46)..(46): gm
  modified_base (47)..(47): 2'O-Methyl Cytosine
  modified_base (48)..(49): gm
  modified_base (50)..(50): 2'O-Methyl Cytosine
  modified_base (51)..(51): gm
  modified_base (52)..(52): 2'O-Methyl Adenosine
  modified_base (53)..(53): 2'O-Methyl Cytosine
  modified_base (54)..(55): gm
  modified_base (56)..(56): um
  modified_base (57)..(57): 2'O-Methyl Adenosine
  modified_base (58)..(58): gm
  modified_base (59)..(59): 2'O-Methyl Adenosine
  modified_base (60)..(61): um
  modified_base (62)..(62): 2'O-Methyl Adenosine
  modified_base (63)..(63): um
  modified_base (64)..(66): 2' Fluoro Guanosine
  modified_base (67)..(67): 2'O-Methyl Cytosine
  modified_base (68)..(68): 2'O-Methyl Adenosine
  modified_base (69)..(69): 2' Fluoro Guanosine
  modified_base (70)..(70): um
  modified_base (71)..(71): 2' Fluoro Guanosine
  modified_base (72)..(72): um
  modified_base (73)..(73): 2' Fluoro Guanosine
  modified_base (74)..(74): 2'O-Methyl Adenosine
  modified_base (75)..(76): 2'O-Methyl Cytosine
  modified_base (77)..(77): gm
  modified_base (78)..(78): 2'O-Methyl Cytosine
  modified_base (79)..(79): gm
  modified_base (80)..(81): 2'O-Methyl Cytosine
  modified_base (82)..(82): gm
  modified_base (83)..(83): inverted deoxythymidine incorporated at the 3'  end
  modified_base (83)..(83): 2'O-Methyl Cytosine
gccgacuccgcgcggaggcuugagguagccguuugucggcuuuuugcggcgacgguagauuaugggcagugugaccgcgccgc

SEQ ID NO: 135 - RNA, 88 nt, Artificial Sequence
  Aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  misc_feature (41)..(50): 2'O-Methyl deoxyuridine linker
  modified_base (41)..(50): 2'O-Methyl deoxyuridine
  modified_base (51)..(51): gm
  modified_base (52)..(52): 2'O-Methyl Cytosine
  modified_base (52)..(52): 2'O-Methyl Cytosine
  modified_base (53)..(54): gm
  modified_base (55)..(55): 2'O-Methyl Cytosine
  modified_base (56)..(56): gm
  modified_base (57)..(57): 2'O-Methyl Adenosine
  modified_base (58)..(58): 2'O-Methyl Cytosine
  modified_base (59)..(60): gm
  modified_base (61)..(61): um
  modified_base (62)..(62): 2'O-Methyl Adenosine
  modified_base (63)..(63): gm
  modified_base (64)..(64): 2'O-Methyl Adenosine
  modified_base (65)..(66): um
  modified_base (67)..(67): 2'O-Methyl Adenosine
  modified_base (68)..(68): um
  modified_base (69)..(71): 2' Fluoro Guanosine
  modified_base (72)..(72): 2'O-Methyl Cytosine
  modified_base (73)..(73): 2'O-Methyl Adenosine
  modified_base (74)..(74): 2' Fluoro Guanosine
  modified_base (75)..(75): um
  modified_base (76)..(76): 2' Fluoro Guanosine
  modified_base (77)..(77): um
  modified_base (78)..(78): 2' Fluoro Guanosine
  modified_base (79)..(79): 2'O-Methyl Adenosine
  modified_base (80)..(81): 2'O-Methyl Cytosine
  modified_base (82)..(82): gm
  modified_base (83)..(83): 2'O-Methyl Cytosine
  modified_base (84)..(84): gm
  modified_base (85)..(86): 2'O-Methyl Cytosine
  modified_base (87)..(87): gm
  modified_base (88)..(88): inverted deoxythymidine incorporated at the 3'  end
  modified_base (88)..(88): 2'O-Methyl Cytosine
gccgacuccgcgcggaggcuugagguagccguuugucggcuuuuuuuuuugcggcgacgguagauuaugggcagugugaccgcgccgc

SEQ ID NO: 136 - RNA, 78 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(45): um
  modified_base (46)..(47): 2'O-Methyl Cytosine
  modified_base (48)..(48): 2' Fluoro Guanosine
  modified_base (49)..(49): 2'O-Methyl Cytosine
  modified_base (50)..(50): 2' Fluoro Guanosine
  modified_base (51)..(51): 2'O-Methyl Cytosine
  modified_base (52)..(53): 2' Fluoro Guanosine
  modified_base (54)..(54): 2'O-Methyl Adenosine
  modified_base (55)..(56): 2' Fluoro Guanosine
  modified_base (57)..(57): 2'O-Methyl Cytosine
  modified_base (58)..(59): um
  modified_base (60)..(60): 2' Fluoro Guanosine
  modified_base (61)..(61): 2'O-Methyl Adenosine
  modified_base (62)..(63): 2' Fluoro Guanosine
  modified_base (64)..(64): um
  modified_base (65)..(65): 2'O-Methyl Adenosine
  modified_base (66)..(66): 2' Fluoro Guanosine
  modified_base (67)..(68): 2'O-Methyl Cytosine
  modified_base (69)..(69): 2' Fluoro Guanosine
  modified_base (69)..(69): gm
  modified_base (70)..(72): um
  modified_base (73)..(73): gm
  modified_base (74)..(74): um
  modified_base (75)..(75): 2'O-Methyl Cytosine
  modified_base (76)..(77): gm
  modified_base (78)..(78): inverted deoxythymidine incorporated at the 3'  end
  modified_base (78)..(78): 2'O-Methyl Cytosine
gcggcgacgguagauuaugggcagugugaccgcgccgcgccgacuccgcgcggaggcuugagguagccguuugucggc

SEQ ID NO: 137 - RNA, 78 nt, Artificial Sequence; identical to SEQ ID NO: 136
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(45): um
  modified_base (46)..(47): 2'O-Methyl Cytosine
  modified_base (48)..(48): 2' Fluoro Guanosine
  modified_base (49)..(49): 2'O-Methyl Cytosine
  modified_base (50)..(50): 2' Fluoro Guanosine
  modified_base (51)..(51): 2'O-Methyl Cytosine
  modified_base (52)..(53): 2' Fluoro Guanosine
  modified_base (54)..(54): 2'O-Methyl Adenosine
  modified_base (55)..(56): 2' Fluoro Guanosine
  modified_base (57)..(57): 2'O-Methyl Cytosine
  modified_base (58)..(59): um
  modified_base (60)..(60): 2' Fluoro Guanosine
  modified_base (61)..(61): 2'O-Methyl Adenosine
  modified_base (62)..(63): 2' Fluoro Guanosine
  modified_base (64)..(64): um
  modified_base (65)..(65): 2'O-Methyl Adenosine
  modified_base (66)..(66): 2' Fluoro Guanosine
  modified_base (67)..(68): 2'O-Methyl Cytosine
  modified_base (69)..(69): 2' Fluoro Guanosine
  modified_base (69)..(69): gm
  modified_base (70)..(72): um
  modified_base (73)..(73): gm
  modified_base (74)..(74): um
  modified_base (75)..(75): 2'O-Methyl Cytosine
  modified_base (76)..(77): gm
  modified_base (78)..(78): inverted deoxythymidine incorporated at the 3'  end
  modified_base (78)..(78): 2'O-Methyl Cytosine

SEQ ID NO: 138 - RNA, 78 nt, Artificial Sequence; identical to SEQ ID NO: 136
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(45): um
  modified_base (46)..(47): 2'O-Methyl Cytosine
  modified_base (48)..(48): 2' Fluoro Guanosine
  modified_base (49)..(49): 2'O-Methyl Cytosine
  modified_base (50)..(50): 2' Fluoro Guanosine
  modified_base (51)..(51): 2'O-Methyl Cytosine
  modified_base (52)..(53): 2' Fluoro Guanosine
  modified_base (54)..(54): 2'O-Methyl Adenosine
  modified_base (55)..(56): 2' Fluoro Guanosine
  modified_base (57)..(57): 2'O-Methyl Cytosine
  modified_base (58)..(59): um
  modified_base (60)..(60): 2' Fluoro Guanosine
  modified_base (61)..(61): 2'O-Methyl Adenosine
  modified_base (62)..(63): 2' Fluoro Guanosine
  modified_base (64)..(64): um
  modified_base (65)..(65): 2'O-Methyl Adenosine
  modified_base (66)..(66): 2' Fluoro Guanosine
  modified_base (67)..(68): 2'O-Methyl Cytosine
  modified_base (69)..(69): 2' Fluoro Guanosine
  modified_base (69)..(69): gm
  modified_base (70)..(72): um
  modified_base (73)..(73): gm
  modified_base (74)..(74): um
  modified_base (75)..(75): 2'O-Methyl Cytosine
  modified_base (76)..(77): gm
  modified_base (78)..(78): inverted deoxythymidine incorporated at the 3'  end
  modified_base (78)..(78): 2'O-Methyl Cytosine

SEQ ID NO: 139 - RNA, 83 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (39)..(43): 2'O-Methyl deoxyuridine linker
  modified_base (39)..(43): 2'O-Methyl deoxyuridine
  modified_base (44)..(44): gm
  modified_base (45)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  modified_base (50)..(50): um
  modified_base (51)..(52): 2'O-Methyl Cytosine
  modified_base (53)..(53): 2' Fluoro Guanosine
  modified_base (54)..(54): 2'O-Methyl Cytosine
  modified_base (55)..(55): 2' Fluoro Guanosine
  modified_base (56)..(56): 2'O-Methyl Cytosine
  modified_base (57)..(58): 2' Fluoro Guanosine
  modified_base (59)..(59): 2'O-Methyl Adenosine
  modified_base (60)..(61): 2' Fluoro Guanosine
  modified_base (62)..(62): 2'O-Methyl Cytosine
  modified_base (63)..(64): um
  modified_base (65)..(65): 2' Fluoro Guanosine
  modified_base (66)..(66): 2'O-Methyl Adenosine
  modified_base (67)..(68): 2' Fluoro Guanosine
  modified_base (69)..(69): um
  modified_base (70)..(70): 2'O-Methyl Adenosine
  modified_base (71)..(71): 2' Fluoro Guanosine
  modified_base (72)..(73): 2'O-Methyl Cytosine
  modified_base (74)..(74): 2' Fluoro Guanosine
  modified_base (75)..(77): um
  modified_base (78)..(78): gm
  modified_base (79)..(79): um
  modified_base (80)..(80): 2'O-Methyl Cytosine
  modified_base (81)..(82): gm
  modified_base (83)..(83): inverted deoxythymidine incorporated at the 3'  end
  modified_base (83)..(83): 2'O-Methyl Cytosine
gcggcgacgguagauuaugggcagugugaccgcgccgcuuuuugccgacuccgcgcggaggcuugagguagccguuugucggc

SEQ ID NO: 140 - RNA, 88 nt, Artificial Sequence
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (39)..(48): 2'O-Methyl deoxyuridine linker
  modified_base (39)..(48): 2'O-Methyl deoxyuridine
  modified_base (49)..(49): gm
  modified_base (50)..(51): 2'O-Methyl Cytosine
  modified_base (52)..(52): gm
  modified_base (53)..(53): 2'O-Methyl Adenosine
  modified_base (54)..(54): 2'O-Methyl Cytosine
  modified_base (55)..(55): um
  modified_base (56)..(57): 2'O-Methyl Cytosine
  modified_base (58)..(58): 2' Fluoro Guanosine
  modified_base (59)..(59): 2'O-Methyl Cytosine
  modified_base (60)..(60): 2' Fluoro Guanosine
  modified_base (61)..(61): 2'O-Methyl Cytosine
  modified_base (62)..(63): 2' Fluoro Guanosine
  modified_base (64)..(64): 2'O-Methyl Adenosine
  modified_base (65)..(66): 2' Fluoro Guanosine
  modified_base (67)..(67): 2'O-Methyl Cytosine
  modified_base (68)..(69): um
  modified_base (70)..(70): 2' Fluoro Guanosine
  modified_base (71)..(71): 2'O-Methyl Adenosine
  modified_base (72)..(73): 2' Fluoro Guanosine
  modified_base (74)..(74): um
  modified_base (75)..(75): 2'O-Methyl Adenosine
  modified_base (76)..(76): 2' Fluoro Guanosine
  modified_base (77)..(78): 2'O-Methyl Cytosine
  modified_base (79)..(79): 2' Fluoro Guanosine
  modified_base (80)..(82): um
  modified_base (83)..(83): gm
  modified_base (84)..(84): um
  modified_base (85)..(85): 2'O-Methyl Cytosine
  modified_base (87)..(87): gm
  modified_base (88)..(88): inverted deoxythymidine incorporated at the 3'  end
  modified_base (88)..(88): 2'O-Methyl Cytosine
gcggcgacgguagauuaugggcagugugaccgcgccgcuuuuuuuuuugccgacuccgcgcggaggcuugagguagccguuugucggc

SEQ ID NO: 141 - RNA, 31 nt, Artificial Sequence; identical to SEQ ID NO: 20
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): 2' Fluoro Guanosine
  modified_base (29)..(29): um
  modified_base (30)..(30): 2'O-Methyl Cytosine
  modified_base (31)..(31): inverted deoxythymidine incorporated at the 3'  end
  modified_base (31)..(31): 2' Fluoro Guanosine

SEQ ID NO: 142 - RNA, 65 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(33): gm
  modified_base (34)..(34): 2'O-Methyl Cytosine
  modified_base (35)..(35): gm
  modified_base (36)..(36): 2'O-Methyl Adenosine
  modified_base (37)..(37): 2'O-Methyl Cytosine
  modified_base (38)..(39): gm
  modified_base (40)..(40): um
  modified_base (41)..(41): 2'O-Methyl Adenosine
  modified_base (42)..(42): gm
  modified_base (43)..(43): 2'O-Methyl Adenosine
  modified_base (44)..(45): um
  modified_base (46)..(46): 2'O-Methyl Adenosine
  modified_base (47)..(47): um
  modified_base (48)..(50): gm
  modified_base (51)..(51): 2'O-Methyl Cytosine
  modified_base (52)..(52): 2'O-Methyl Adenosine
  modified_base (53)..(53): gm
  modified_base (54)..(54): um
  modified_base (55)..(55): gm
  modified_base (56)..(56): um
  modified_base (57)..(57): gm
  modified_base (58)..(58): 2'O-Methyl Adenosine
  modified_base (59)..(60): 2'O-Methyl Cytosine
  modified_base (61)..(61): gm
  modified_base (62)..(62): 2'O-Methyl Cytosine
  modified_base (63)..(63): gm
  modified_base (64)..(65): 2'O-Methyl Cytosine
  modified_base (65)..(65): inverted deoxythymidine incorporated at the 3'  end
ccgcgcggaggcuugagguagccguuugucgggcgacgguagauuaugggcagugugaccgcgcc

SEQ ID NO: 143 - RNA, 31 nt, Artificial Sequence; identical to SEQ ID NO: 20
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  misc_feature (31)..(31): The 2'O-Methyl guanosine is attached  through the linker 1,3-propanediolspacer to 2'O-Methyl guanosine of SEQ ID NO: 433
  modified_base (31)..(31): gm

SEQ ID NO: 144 - RNA, 31 nt, Artificial Sequence; identical to SEQ ID NO: 20
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  misc_feature (31)..(31): The 2'O-Methyl guanosine is attached through the linker hexaethylene glycol spacer to 2'O-Methyl guanosine of SEQ ID NO:434
  modified_base (31)..(31): gm

SEQ ID NO: 145 - RNA, 70 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  misc_feature (32)..(36): 2'O-Methyl deoxyuridine linker
  modified_base (32)..(36): 2'O-Methyl deoxyuridine
  modified_base (37)..(38): gm
  modified_base (39)..(39): 2'O-Methyl Cytosine
  modified_base (40)..(40): gm
  modified_base (41)..(41): 2'O-Methyl Adenosine
  modified_base (42)..(42): 2'O-Methyl Cytosine
  modified_base (43)..(44): gm
  modified_base (45)..(45): um
  modified_base (46)..(46): 2'O-Methyl Adenosine
  modified_base (47)..(47): gm
  modified_base (48)..(48): 2'O-Methyl Adenosine
  modified_base (49)..(50): um
  modified_base (51)..(51): 2'O-Methyl Adenosine
  modified_base (52)..(52): um
  modified_base (53)..(55): 2' Fluoro Guanosine
  modified_base (56)..(56): 2'O-Methyl Cytosine
  modified_base (57)..(57): 2'O-Methyl Adenosine
  modified_base (58)..(58): 2' Fluoro Guanosine
  modified_base (59)..(59): um
  modified_base (60)..(60): 2' Fluoro Guanosine
  modified_base (61)..(61): um
  modified_base (62)..(62): 2' Fluoro Guanosine
  modified_base (63)..(63): 2'O-Methyl Adenosine
  modified_base (64)..(65): 2'O-Methyl Cytosine
  modified_base (66)..(66): gm
  modified_base (67)..(67): 2'O-Methyl Cytosine
  modified_base (68)..(68): gm
  modified_base (69)..(70): 2'O-Methyl Cytosine
  modified_base (70)..(70): inverted deoxythymidine incorporated at the 3'  end
ccgcgcggaggcuugagguagccguuugucguuuuuggcgacgguagauuaugggcagugugaccgcgcc

SEQ ID NO: 146 - RNA, 75 nt, Artificial Sequence
  Aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  misc_feature (32)..(41): 2'O-Methyl deoxyuridine linker
  modified_base (32)..(41): 2'O-Methyl deoxyuridine
  modified_base (42)..(43): gm
  modified_base (44)..(44): 2'O-Methyl Cytosine
  modified_base (45)..(45): gm
  modified_base (46)..(46): 2'O-Methyl Adenosine
  modified_base (47)..(47): 2'O-Methyl Cytosine
  modified_base (48)..(49): gm
  modified_base (50)..(50): um
  modified_base (51)..(51): 2'O-Methyl Adenosine
  modified_base (52)..(52): gm
  modified_base (53)..(53): 2'O-Methyl Adenosine
  modified_base (54)..(55): um
  modified_base (56)..(56): 2'O-Methyl Adenosine
  modified_base (57)..(57): um
  modified_base (58)..(60): 2' Fluoro Guanosine
  modified_base (61)..(61): 2'O-Methyl Cytosine
  modified_base (62)..(62): 2'O-Methyl Adenosine
  modified_base (63)..(63): 2' Fluoro Guanosine
  modified_base (64)..(64): um
  modified_base (65)..(65): 2' Fluoro Guanosine
  modified_base (66)..(66): um
  modified_base (67)..(67): 2' Fluoro Guanosine
  modified_base (68)..(68): 2'O-Methyl Adenosine
  modified_base (69)..(70): 2'O-Methyl Cytosine
  modified_base (71)..(71): gm
  modified_base (72)..(72): 2'O-Methyl Cytosine
  modified_base (73)..(73): gm
  modified_base (74)..(75): 2'O-Methyl Cytosine
  modified_base (75)..(75): inverted deoxythymidine incorporated at the 3'  end
ccgcgcggaggcuugagguagccguuugucguuuuuuuuuuggcgacgguagauuaugggcagugugaccgcgcc

SEQ ID NO: 147 - RNA, 38 nt, Artificial Sequence; identical to SEQ ID NO: 62
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (10)..(10): 2'O-Methyl Adenosine
  modified_base (11)..(11): gm
  modified_base (12)..(12): 2'O-Methyl Adenosine
  modified_base (15)..(15): 2'O-Methyl Adenosine
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (24)..(24): 2' Fluoro Guanosine
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(35): 2'O-Methyl Cytosine
  modified_base (36)..(36): gm
  modified_base (37)..(37): 2'O-Methyl Adenosine
  misc_feature (38)..(38): The 2'O-Methyl cytosine is attached  through the linker 1,3-propanediolspacer to 2'O-Methyl cytosine of SEQ ID NO: 435
  modified_base (38)..(38): 2'O-Methyl Cytosine

SEQ ID NO: 148 - RNA, 34 nt, Artificial Sequence; identical to SEQ ID NO: 48
  Aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  misc_feature (34)..(34): The 2'O-Methyl cytosine is attached  through the linker 1,3-propanediolspacer to 2'O-Methyl cytosine of another nucleotide sequence CXAC

SEQ ID NO: 149 - RNA, 34 nt, Artificial Sequence; identical to SEQ ID NO: 48
  Aptamer 269
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine

SEQ ID NO: 150 - RNA, 43 nt, Artificial Sequence; identical to SEQ ID NO: 65
  Aptamer  269
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(39): 2'O-Methyl deoxyuridine
  misc_feature (35)..(39): 2'O-Methyl deoxyuridine linker
  modified_base (40)..(40): 2'O-Methyl Cytosine
  modified_base (41)..(41): gm
  modified_base (42)..(42): 2'O-Methyl Adenosine
  modified_base (43)..(43): 2'O-Methyl Cytosine
  misc_feature (43)..(43): The 2'O-Methyl cytosine is attached  through the linker 1,3-propanediolspacer to 2'O-Methyl cytosine of SEQ ID NO: 438

SEQ ID NO: 151 - RNA, 48 nt, Artificial Sequence; identical to SEQ ID NO: 66
  Aptamer 269
  modified_base (1)..(2): gm
  modified_base (3)..(3): gm
  modified_base (3)..(3): 2'O-Methyl Cytosine
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(44): 2'O-Methyl deoxyuridine
  misc_feature (35)..(44): 2'O-Methyl deoxyuridine linker
  modified_base (45)..(45): 2'O-Methyl Cytosine
  modified_base (46)..(46): gm
  modified_base (47)..(47): 2'O-Methyl Adenosine
  modified_base (48)..(48): 2'O-Methyl Cytosine
  misc_feature (48)..(48): The 2'O-Methyl cytosine is attached  through the linker 1,3-propanediolspacer to 2'O-Methyl cytosine of SEQ ID NO: 442

SEQ ID NO: 152 - RNA, 33 nt, Artificial Sequence
  Aptamer 628
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
ccgcgcggaggcuugagguagccguuugucggc

SEQ ID NO: 153 - RNA, 31 nt, Artificial Sequence; identical to SEQ ID NO: 20
  Aptamer 628
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  misc_feature (31)..(31): The 2'O-Methyl guanosine is attached  through the linker 1,3-propanediolspacer to 2'O-Methyl guanosine of SEQ ID NO: 303

SEQ ID NO: 154 - RNA, 31 nt, Artificial Sequence; identical to SEQ ID NO: 20
  Aptamer 628
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (5)..(5): 2' Fluoro Guanosine
  modified_base (7)..(8): 2' Fluoro Guanosine
  modified_base (9)..(9): 2'O-Methyl Adenosine
  modified_base (9)..(9): 2'O-Methyl Cytosinee
  modified_base (10)..(11): 2' Fluoro Guanosine
  modified_base (13)..(14): um
  modified_base (15)..(15): 2' Fluoro Guanosine
  modified_base (16)..(16): 2'O-Methyl Adenosine
  modified_base (16)..(16): 2'O-Methyl Cytosinee
  modified_base (17)..(18): 2' Fluoro Guanosine
  modified_base (19)..(19): um
  modified_base (20)..(20): 2'O-Methyl Adenosine
  modified_base (20)..(20): 2'O-Methyl Cytosinee
  modified_base (21)..(21): 2' Fluoro Guanosine
  modified_base (24)..(24): 2' Fluoro Guanosine
  modified_base (25)..(27): um
  modified_base (28)..(28): gm
  modified_base (29)..(29): um
  misc_feature (31)..(31): The 2'O-Methyl guanosine is attached through the linker hexaethylene glycol spacer to 2'O-Methyl guanosine of SEQ ID NO:304
  modified_base (31)..(31): gm

SEQ ID NO: 155 - RNA, 74 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(36): 2'O-Methyl deoxyuridine
  misc_feature (32)..(36): 2'O-Methyl deoxyuridine linker
  modified_base (37)..(37): gm
  modified_base (38)..(38): 2'O-Methyl Cytosine
  modified_base (39)..(40): gm
  modified_base (41)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(46): gm
  modified_base (47)..(47): um
  modified_base (48)..(48): 2'O-Methyl Adenosine
  modified_base (49)..(49): gm
  modified_base (50)..(50): 2'O-Methyl Adenosine
  modified_base (51)..(52): um
  modified_base (53)..(53): 2'O-Methyl Adenosine
  modified_base (54)..(54): um
  modified_base (55)..(57): 2' Fluoro Guanosine
  modified_base (58)..(58): 2'O-Methyl Cytosine
  modified_base (59)..(59): 2'O-Methyl Adenosine
  modified_base (60)..(60): 2' Fluoro Guanosine
  modified_base (61)..(61): um
  modified_base (62)..(62): 2' Fluoro Guanosine
  modified_base (63)..(63): um
  modified_base (64)..(64): 2' Fluoro Guanosine
  modified_base (65)..(65): 2'O-Methyl Adenosine
  modified_base (66)..(67): 2'O-Methyl Cytosine
  modified_base (68)..(68): gm
  modified_base (69)..(69): 2'O-Methyl Cytosine
  modified_base (70)..(70): gm
  modified_base (71)..(72): 2'O-Methyl Cytosine
  modified_base (73)..(73): gm
  modified_base (74)..(74): 2'O-Methyl Cytosine
ccgcgcggaggcuugagguagccguuugucguuuuugcggcgacgguagauuaugggcagugugaccgcgccgc

SEQ ID NO: 156 - RNA, 79 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(41): 2'O-Methyl deoxyuridine
  misc_feature (32)..(41): 2'O-Methyl deoxyuridine linker
  modified_base (42)..(42): gm
  modified_base (43)..(43): 2'O-Methyl Cytosine
  modified_base (44)..(45): gm
  modified_base (46)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  modified_base (50)..(51): gm
  modified_base (52)..(52): um
  modified_base (53)..(53): 2'O-Methyl Adenosine
  modified_base (54)..(54): gm
  modified_base (55)..(55): 2'O-Methyl Adenosine
  modified_base (56)..(57): um
  modified_base (58)..(58): 2'O-Methyl Adenosine
  modified_base (59)..(59): um
  modified_base (60)..(62): 2' Fluoro Guanosine
  modified_base (63)..(63): 2'O-Methyl Cytosine
  modified_base (64)..(64): 2'O-Methyl Adenosine
  modified_base (65)..(65): 2' Fluoro Guanosine
  modified_base (66)..(66): um
  modified_base (67)..(67): 2' Fluoro Guanosine
  modified_base (68)..(68): um
  modified_base (69)..(69): 2' Fluoro Guanosine
  modified_base (70)..(70): 2'O-Methyl Adenosine
  modified_base (71)..(72): 2'O-Methyl Cytosine
  modified_base (73)..(73): gm
  modified_base (74)..(74): 2'O-Methyl Cytosine
  modified_base (75)..(75): gm
  modified_base (76)..(77): 2'O-Methyl Cytosine
  modified_base (78)..(78): gm
  modified_base (79)..(79): 2'O-Methyl Cytosine
ccgcgcggaggcuugagguagccguuugucguuuuuuuuuugcggcgacgguagauuaugggcagugugaccgcgccgc

SEQ ID NO: 157 - RNA, 38 nt, Artificial Sequence; identical to SEQ ID NO: 62
  aptamer
  modified_base (1)..(2): gm
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(35): 2'O-Methyl Cytosine
  modified_base (36)..(36): gm
  modified_base (37)..(37): 2'O-Methyl Adenosine
  misc_feature (38)..(38): The 2'O-Methyl cytosine is attached  through the linker 1,3-propanediolspacer to 2'O-Methyl cytosine of SEQ ID NO: 305
  misc_feature (38)..(38): The 2'O-Methyl cytosine is attached  through the linker 1,3-propanediolspacer to 2'O-Methyl cytosine of SEQ ID NO: 305
  modified_base (38)..(38): 2'O-Methyl Cytosine
  misc_feature (38)..(38): The 2'O-Methyl cytosine is attached  through the linker 1,3-propanediolspacer to 2'O-Methyl cytosine of SEQ ID NO: 305

SEQ ID NO: 158 - RNA, 38 nt, Artificial Sequence; identical to SEQ ID NO: 78
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (15)..(15): 2'O-Methyl Adenosine
  modified_base (15)..(16): um
  modified_base (18)..(18): um
  modified_base (19)..(21): 2' Fluoro Guanosine
  modified_base (21)..(21): 2'O-Methyl Adenosine
  modified_base (22)..(22): 2'O-Methyl Cytosine
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (27)..(27): um
  modified_base (28)..(28): 2' Fluoro Guanosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  misc_feature (38)..(38): The 2'O-Methyl cytosine is attached  through the linker 1,3-propanediolspacer to 2'O-Methyl cytosine of another nucleotide sequence CXAC

SEQ ID NO: 159 - RNA, 38 nt, Artificial Sequence; identical to SEQ ID NO: 78
  aptamer
  modified_base (2)..(2): 2'O-Methyl Cytosine
  modified_base (5)..(5): 2'O-Methyl Cytosine
  modified_base (7)..(7): 2'O-Methyl Adenosine
  modified_base (8)..(8): 2'O-Methyl Cytosine
  modified_base (11)..(11): um
  modified_base (12)..(12): 2'O-Methyl Adenosine
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (19)..(21): gm
  modified_base (22)..(22): 2'O-Methyl Cytosine
  modified_base (23)..(23): 2'O-Methyl Adenosine
  modified_base (24)..(24): 2' Fluoro Guanosine
  modified_base (24)..(24): gm
  modified_base (25)..(25): um
  modified_base (26)..(26): 2' Fluoro Guanosine
  modified_base (26)..(26): gm
  modified_base (27)..(27): um
  modified_base (28)..(28): 2' Fluoro Guanosine
  modified_base (28)..(28): gm
  modified_base (29)..(29): 2'O-Methyl Adenosine
  modified_base (29)..(29): 2'O-Methyl Adenosine
  modified_base (30)..(31): 2'O-Methyl Cytosine
  modified_base (33)..(33): 2'O-Methyl Cytosine
  modified_base (35)..(36): 2'O-Methyl Cytosine
  modified_base (38)..(38): 2'O-Methyl Cytosine
  misc_feature (38)..(38): The 2'O-Methyl cytosine is attached  through the linker Hexaethyleneglycol spacer to 2'O-Methyl cytosine of another nucleotide sequence CXAC

SEQ ID NO: 160 - RNA, 47 nt, Artificial Sequence
  aptamer
  modified_base (1)..(2): gm
  modified_base (3)..(3): 2'O-Methyl Cytosine
  modified_base (4)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(43): 2'O-Methyl deoxyuridine
  misc_feature (39)..(43): 2'O-Methyl deoxyuridine linker
  modified_base (44)..(44): 2'O-Methyl Cytosine
  modified_base (45)..(45): gm
  modified_base (46)..(46): 2'O-Methyl Adenosine
  modified_base (47)..(47): 2'O-Methyl Cytosine
  misc_feature (47)..(47): The 2'O-Methyl cytosine is attached  through the linker 1,3-propanediolspacer to 2'O-Methyl cytosine of SEQ ID NO: 308
ggcgcgacgguagauuaugggcagugugaccgcgccgcuuuuucgac

SEQ ID NO: 161 - RNA, 52 nt, Artificial Sequence; identical to SEQ ID NO: 88
  aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(48): 2'O-Methyl deoxyuridine
  misc_feature (39)..(48): 2'O-Methyl deoxyuridine linker
  modified_base (49)..(49): 2'O-Methyl Cytosine
  modified_base (50)..(50): gm
  modified_base (51)..(51): 2'O-Methyl Adenosine
  modified_base (52)..(52): 2'O-Methyl Cytosine
  misc_feature (52)..(52): The 2'O-Methyl cytosine is attached  through the linker 1,3-propanediolspacer to 2'O-Methyl cytosine of SEQ ID NO: 309

SEQ ID NO: 162 - RNA, 71 nt, Artificial Sequence
  aptamer
  modified_base (1)..(2): 2'O-Methyl Cytosine
  misc_feature (1)..(1): The 2'O-Methyl cytosine is attached  through the linker 1,3-propanediol to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(34): gm
  modified_base (35)..(35): 2'O-Methyl Cytosine
  modified_base (36)..(37): gm
  modified_base (38)..(38): 2'O-Methyl Cytosine
  modified_base (39)..(39): gm
  modified_base (40)..(40): 2'O-Methyl Adenosine
  modified_base (41)..(41): 2'O-Methyl Cytosine
  modified_base (42)..(43): gm
  modified_base (44)..(44): um
  modified_base (45)..(45): 2'O-Methyl Adenosine
  modified_base (46)..(46): gm
  modified_base (47)..(47): 2'O-Methyl Adenosine
  modified_base (48)..(49): um
  modified_base (50)..(50): 2'O-Methyl Adenosine
  modified_base (51)..(51): um
  modified_base (52)..(54): 2' Fluoro Guanosine
  modified_base (55)..(55): 2'O-Methyl Cytosine
  modified_base (56)..(56): 2'O-Methyl Adenosine
  modified_base (57)..(57): 2' Fluoro Guanosine
  modified_base (58)..(58): um
  modified_base (59)..(59): 2' Fluoro Guanosine
  modified_base (60)..(60): um
  modified_base (61)..(61): 2' Fluoro Guanosine
  modified_base (62)..(62): 2'O-Methyl Adenosine
  modified_base (63)..(64): 2'O-Methyl Cytosine
  modified_base (65)..(65): gm
  modified_base (66)..(66): 2'O-Methyl Cytosine
  modified_base (67)..(67): gm
  modified_base (68)..(69): 2'O-Methyl Cytosine
  modified_base (70)..(70): gm
  modified_base (71)..(71): 2'O-Methyl Cytosine
ccgcgcggaggcuugagguagccguuugucggcgcggcgacgguagauuaugggcagugugaccgcgccgc

SEQ ID NO: 163 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(32): gm
  modified_base (33)..(33): 2'O-Methyl Cytosine
  misc_feature (33)..(33): The 2'O-Methyl cytosine is attached  through the linker 1,3-propanediolspacer to 2'O-Methyl guanosine of SEQ ID NO: 310

SEQ ID NO: 164 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(25): 2'O-Methyl Adenosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(32): gm
  modified_base (33)..(33): 2'O-Methyl Cytosine
  misc_feature (33)..(33): The 2'O-Methyl cytosine is attached through the linker hexaethylene glycol spacer to 2'O-Methyl guanosine of SEQ ID NO:311

SEQ ID NO: 165 - RNA, 38 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker is attached to 2'O-Methyl guanosine of SEQ ID NO:312
ccgcgcggaggcuugagguagccguuugucggcuuuuu

SEQ ID NO: 166 - RNA, 81 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): gm
  modified_base (45)..(45): 2'O-Methyl Cytosine
  modified_base (46)..(47): gm
  modified_base (48)..(48): 2'O-Methyl Cytosine
  modified_base (49)..(49): gm
  modified_base (50)..(50): 2'O-Methyl Adenosine
  modified_base (51)..(51): 2'O-Methyl Cytosine
  modified_base (52)..(53): gm
  modified_base (54)..(54): um
  modified_base (55)..(55): 2'O-Methyl Adenosine
  modified_base (56)..(56): gm
  modified_base (57)..(57): 2'O-Methyl Adenosine
  modified_base (58)..(59): um
  modified_base (60)..(60): 2'O-Methyl Adenosine
  modified_base (61)..(61): um
  modified_base (62)..(64): 2' Fluoro Guanosine
  modified_base (65)..(65): 2'O-Methyl Cytosine
  modified_base (66)..(66): 2'O-Methyl Adenosine
  modified_base (67)..(67): 2' Fluoro Guanosine
  modified_base (68)..(68): um
  modified_base (69)..(69): 2' Fluoro Guanosine
  modified_base (70)..(70): um
  modified_base (71)..(71): 2' Fluoro Guanosine
  modified_base (72)..(72): 2'O-Methyl Adenosine
  modified_base (73)..(74): 2'O-Methyl Cytosine
  modified_base (75)..(75): gm
  modified_base (76)..(76): 2'O-Methyl Cytosine
  modified_base (77)..(77): gm
  modified_base (78)..(79): 2'O-Methyl Cytosine
  modified_base (80)..(80): gm
  modified_base (81)..(81): 2'O-Methyl Cytosine
ccgcgcggaggcuugagguagccguuugucggcuuuuuuuuuugcggcgacgguagauuaugggcagugugaccgcgccgc

SEQ ID NO: 167 - RNA, 44 nt, Artificial Sequence; identical to SEQ ID NO: 94
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  misc_feature (44)..(44): The 2'O-Methyl cytosine is attached  through the linker 1,3-propanediolspacer to 2'O-Methyl cytosine of SEQ ID NO: 313

SEQ ID NO: 168 - RNA, 44 nt, Artificial Sequence; identical to SEQ ID NO: 94
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  misc_feature (44)..(44): The 2'O-Methyl cytosine is attached  through the linker 1,3-propanediolspacer to 2'O-Methyl cytosine of SEQ ID NO: 314

SEQ ID NO: 169 - RNA, 44 nt, Artificial Sequence; identical to SEQ ID NO: 94
  Aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  misc_feature (44)..(44): The 2'O-Methyl cytosine is attached  through the linker 1,3-propanediolspacer to 2'O-Methyl cytosine of SEQ ID NO: 315

SEQ ID NO: 170 - RNA, 49 nt, Artificial Sequence; identical to SEQ ID NO: 97
  aptamer
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(43): 2'O-Methyl deoxyuridine
  misc_feature (39)..(43): 2'O-Methyl deoxyuridine linker
  modified_base (44)..(44): gm
  modified_base (45)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  misc_feature (49)..(49): The 2'O-Methyl cytosine is attached  through the linker 1,3-propanediolspacer to 2'O-Methyl cytosine of SEQ ID NO: 316

SEQ ID NO: 171 - RNA, 54 nt, Artificial Sequence; identical to SEQ ID NO: 98
  aptamer
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(48): 2'O-Methyl deoxyuridine
  misc_feature (39)..(48): 2'O-Methyl deoxyuridine linker
  modified_base (49)..(49): gm
  modified_base (50)..(51): 2'O-Methyl Cytosine
  modified_base (52)..(52): gm
  modified_base (53)..(53): 2'O-Methyl Adenosine
  modified_base (54)..(54): 2'O-Methyl Cytosine
  misc_feature (54)..(54): The 2'O-Methyl cytosine is attached  through the linker 1,3-propanediolspacer to 2'O-Methyl cytosine of SEQ ID NO: 317

SEQ ID NO: 172 - RNA, 29 nt, Artificial Sequence
  Aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
gcggugggaaaugugagauggguugccgc

SEQ ID NO: 173 - RNA, 62 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(37): gm
  modified_base (38)..(38): um
  modified_base (39)..(41): 2' Fluoro Guanosine
  modified_base (42)..(44): 2'O-Methyl Adenosine
  modified_base (45)..(45): um
  modified_base (46)..(46): 2' Fluoro Guanosine
  modified_base (47)..(47): um
  modified_base (48)..(48): 2' Fluoro Guanosine
  modified_base (49)..(49): 2'O-Methyl Adenosine
  modified_base (50)..(50): 2' Fluoro Guanosine
  modified_base (51)..(51): 2'O-Methyl Adenosine
  modified_base (52)..(52): um
  modified_base (53)..(55): 2' Fluoro Guanosine
  modified_base (56)..(57): um
  modified_base (58)..(58): gm
  modified_base (59)..(60): 2'O-Methyl Cytosine
  modified_base (61)..(61): gm
  modified_base (62)..(62): 2'O-Methyl Cytosine
ccgcgcggagggguuucauaaucccguuugucggcggugggaaaugugagauggguugccgc

SEQ ID NO: 174 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (33)..(33): The 2'O-Methyl guanosine is attached  through the linker 1,3-propanediolspacer to 2'O-Methyl guanosine of SEQ ID NO: 318

SEQ ID NO: 175 - RNA, 33 nt, Artificial Sequence; identical to SEQ ID NO: 1
  aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  misc_feature (33)..(33): The 2'O-Methyl guanosine is attached through the linker Hexaethyleneglycol spacer to 2'O-Methyl guanosine of  SEQ ID NO: 319
  modified_base (33)..(33): gm

SEQ ID NO: 176 - RNA, 67 nt, Artificial Sequence
  aptamer
  misc_feature (1)..(1): The 2'O-Methyl cytosine is attached  through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (23)..(25): 2'O-Methyl Cytosine
  modified_base (26)..(26): 2' Fluoro Guanosine
  modified_base (32)..(32): 2'O-Methyl Cytosine
  misc_feature (34)..(38): 2'O-Methyl deoxyuridine linker
  modified_base (34)..(38): 2'O-Methyl deoxyuridine
  modified_base (40)..(40): 2'O-Methyl Cytosine
  modified_base (44)..(46): 2' Fluoro Guanosine
  modified_base (47)..(49): 2'O-Methyl Adenosine
  modified_base (51)..(51): 2' Fluoro Guanosine
  modified_base (53)..(53): 2' Fluoro Guanosine
  modified_base (54)..(54): 2'O-Methyl Adenosine
  modified_base (55)..(55): 2' Fluoro Guanosine
  modified_base (56)..(56): 2'O-Methyl Adenosine
  modified_base (58)..(60): 2' Fluoro Guanosine
  modified_base (64)..(65): 2'O-Methyl Cytosine
  modified_base (67)..(67): 2'O-Methyl Cytosine
ccgcgcggagggguuucauaaucccguuugucguuuuugcggugggaaaugugagauggguugccgc

SEQ ID NO: 177 - RNA, 72 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (34)..(43): 2'O-Methyl deoxyuridine
  misc_feature (34)..(43): 2'O-Methyl deoxyuridine linker
  modified_base (44)..(44): gm
  modified_base (45)..(45): 2'O-Methyl Cytosine
  modified_base (46)..(47): gm
  modified_base (48)..(48): um
  modified_base (49)..(51): 2' Fluoro Guanosine
  modified_base (52)..(54): 2'O-Methyl Adenosine
  modified_base (55)..(55): um
  modified_base (56)..(56): 2' Fluoro Guanosine
  modified_base (57)..(57): um
  modified_base (58)..(58): 2' Fluoro Guanosine
  modified_base (59)..(59): 2'O-Methyl Adenosine
  modified_base (60)..(60): 2' Fluoro Guanosine
  modified_base (61)..(61): 2'O-Methyl Adenosine
  modified_base (62)..(62): um
  modified_base (63)..(65): 2' Fluoro Guanosine
  modified_base (66)..(67): um
  modified_base (68)..(68): gm
  modified_base (69)..(70): 2'O-Methyl Cytosine
  modified_base (71)..(71): gm
  modified_base (72)..(72): 2'O-Methyl Cytosine
ccgcgcggagggguuucauaaucccguuugucguuuuuuuuuugcggugggaaaugugagauggguugccgc

SEQ ID NO: 178 - RNA, 33 nt, Artificial Sequence
  aptamer
  modified_base (2)..(2): 2'O-Methyl Cytosine
  modified_base (5)..(5): um
  modified_base (6)..(8): 2' Fluoro Guanosine
  modified_base (9)..(11): 2'O-Methyl Adenosine
  modified_base (9)..(11): gm
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (16)..(16): gm
  modified_base (17)..(17): 2' Fluoro Guanosine
  modified_base (18)..(18): 2'O-Methyl Adenosine
  modified_base (18)..(18): gm
  modified_base (19)..(19): um
  modified_base (20)..(22): 2' Fluoro Guanosine
  modified_base (23)..(24): um
  modified_base (26)..(27): 2'O-Methyl Cytosine
  modified_base (29)..(29): 2'O-Methyl Cytosine
  modified_base (30)..(30): 2'O-Methyl Cytosine
  modified_base (31)..(31): gm
  modified_base (32)..(32): 2'O-Methyl Adenosine
  modified_base (33)..(33): 2'O-Methyl Cytosine
  misc_feature (33)..(33): The 2'O-Methyl cytosine is attached  through the linker 1,3-propanediolspacer to 2'O-Methyl cytosine of SEQ ID NO: 320
gcggugggaaaugugagauggguugccgccgac

SEQ ID NO: 179 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached  through the linker 1,3-propanediolspacer to 2'O-Methyl cytosine of another nucleotide sequence CXAC
gcggugggaaaugugagauggguugccgc

SEQ ID NO: 180 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(26): 2'O-Methyl Cytosine
  modified_base (27)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached  through the linker Hexaethyleneglycol spacer to 2'O-Methyl cytosine of another nucleotide sequence CXAC
gcggugggaaaugugagauggguugccgc

SEQ ID NO: 181 - RNA, 38 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  modified_base (35)..(35): 2'O-Methyl Cytosine
  modified_base (36)..(36): gm
  modified_base (37)..(37): 2'O-Methyl Adenosine
  modified_base (38)..(38): 2'O-Methyl Cytosine
  misc_feature (38)..(38): The 2'O-Methyl cytosine is attached  through the linker 1,3-propanediolspacer to 2'O-Methyl cytosine of SEQ ID NO: 323
gcggugggaaaugugagauggguugccgcuuuuucgac

SEQ ID NO: 182 - RNA, 39 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(39): 2'O-Methyl deoxyuridine
  misc_feature (30)..(39): 2'O-Methyl deoxyuridine linker is attached to 2'O-Methyl cytosine of another nucleotide sequence CXAC
gcggugggaaaugugagauggguugccgcuuuuuuuuuu

SEQ ID NO: 183 - RNA, 64 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(36): gm
  modified_base (37)..(37): 2'O-Methyl Cytosine
  modified_base (38)..(39): gm
  modified_base (40)..(40): um
  modified_base (41)..(43): 2' Fluoro Guanosine
  modified_base (44)..(46): 2'O-Methyl Adenosine
  modified_base (47)..(47): um
  modified_base (48)..(48): 2' Fluoro Guanosine
  modified_base (49)..(49): um
  modified_base (50)..(50): 2' Fluoro Guanosine
  modified_base (51)..(51): 2'O-Methyl Adenosine
  modified_base (52)..(52): 2' Fluoro Guanosine
  modified_base (53)..(53): 2'O-Methyl Adenosine
  modified_base (54)..(54): um
  modified_base (55)..(57): 2' Fluoro Guanosine
  modified_base (58)..(59): um
  modified_base (60)..(60): gm
  modified_base (61)..(62): 2'O-Methyl Cytosine
  modified_base (63)..(63): gm
  modified_base (64)..(64): 2'O-Methyl Cytosine
ccgcgcggagggguuucauaaucccguuugucggcgcggugggaaaugugagauggguugccgc

SEQ ID NO: 184 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (35)..(35): The 2'O-Methyl cytosine is attached  through the linker 1,3-propanediolspacer to 2'O-Methyl guanosine of SEQ ID NO: 325

SEQ ID NO: 185 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (35)..(35): The 2'O-Methyl cytosine is attached through the linker Hexaethyleneglycol spacer to 2'O-Methyl guanosine of  SEQ ID NO: 326

SEQ ID NO: 186 - RNA, 69 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(40): 2'O-Methyl deoxyuridine
  misc_feature (36)..(40): 2'O-Methyl deoxyuridine linker
  modified_base (41)..(41): gm
  modified_base (42)..(42): 2'O-Methyl Cytosine
  modified_base (43)..(44): gm
  modified_base (45)..(45): um
  modified_base (46)..(48): 2' Fluoro Guanosine
  modified_base (49)..(51): 2'O-Methyl Adenosine
  modified_base (52)..(52): um
  modified_base (53)..(53): 2' Fluoro Guanosine
  modified_base (54)..(54): um
  modified_base (55)..(55): 2' Fluoro Guanosine
  modified_base (56)..(56): 2'O-Methyl Adenosine
  modified_base (57)..(57): 2' Fluoro Guanosine
  modified_base (58)..(58): 2'O-Methyl Adenosine
  modified_base (59)..(59): um
  modified_base (60)..(62): 2' Fluoro Guanosine
  modified_base (63)..(64): um
  modified_base (65)..(65): gm
  modified_base (66)..(67): 2'O-Methyl Cytosine
  modified_base (68)..(68): gm
  modified_base (69)..(69): 2'O-Methyl Cytosine
ccgcgcggagggguuucauaaucccguuugucggcuuuuugcggugggaaaugugagauggguugccgc

SEQ ID NO: 187 - RNA, 74 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): 2'O-Methyl Uridine
  modified_base (17)..(17): 2'O-Methyl Cytosine
  modified_base (18)..(18): 2'O-Methyl Adenosine
  modified_base (19)..(19): 2'O-Methyl Uridine
  modified_base (20)..(20): 2'O-Methyl Adenosine
  modified_base (20)..(21): 2'O-Methyl Adenosine
  modified_base (22)..(22): 2'O-Methyl Cytosine
  modified_base (23)..(25): 2'O-Methyl Cytosine
  modified_base (26)..(26): 2' Fluoro Guanosine
  modified_base (27)..(29): 2'O-Methyl Uridine
  modified_base (30)..(30): gm
  modified_base (31)..(31): 2'O-Methyl Uridine
  modified_base (32)..(32): 2'O-Methyl Cytosine
  modified_base (33)..(34): gm
  modified_base (35)..(35): 2'O-Methyl Cytosine
  modified_base (36)..(45): 2'O-Methyl deoxyuridine
  misc_feature (36)..(45): 2'O-Methyl deoxyuridine linker
  modified_base (46)..(46): gm
  modified_base (47)..(47): 2'O-Methyl Cytosine
  modified_base (48)..(49): gm
  modified_base (50)..(50): 2'O-Methyl Uridine
  modified_base (51)..(53): 2' Fluoro Guanosine
  modified_base (54)..(56): 2'O-Methyl Adenosine
  modified_base (57)..(57): 2'O-Methyl Uridine
  modified_base (58)..(58): 2' Fluoro Guanosine
  modified_base (59)..(59): 2'O-Methyl Uridine
  modified_base (60)..(60): 2' Fluoro Guanosine
  modified_base (61)..(61): 2'O-Methyl Adenosine
  modified_base (62)..(62): 2' Fluoro Guanosine
  modified_base (63)..(63): 2'O-Methyl Adenosine
  modified_base (64)..(64): 2'O-Methyl Uridine
  modified_base (65)..(67): 2' Fluoro Guanosine
  modified_base (68)..(69): 2'O-Methyl Uridine
  modified_base (70)..(70): gm
  modified_base (71)..(72): 2'O-Methyl Cytosine
  modified_base (73)..(73): gm
  modified_base (74)..(74): 2'O-Methyl Cytosine
ccgcgcggagggguuucauaaucccguuugucggcuuuuuuuuuugcggugggaaaugugagauggguugccgc

SEQ ID NO: 188 - RNA, 35 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (13)..(13): gm
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(29): 2'O-Methyl Cytosine
  modified_base (28)..(28): gm
  modified_base (30)..(30): gm
  modified_base (31)..(32): 2'O-Methyl Cytosine
  modified_base (33)..(33): gm
  modified_base (34)..(34): 2'O-Methyl Adenosine
  modified_base (35)..(35): 2'O-Methyl Cytosine
  misc_feature (35)..(35): The 2'O-Methyl cytosine is attached  through the linker 1,3-propanediolspacer to 2'O-Methyl cytosine of SEQ ID NO: 327
gcggugggaaaugugagauggguugccgcgccgac

SEQ ID NO: 189 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached  through the linker 1,3-propanediolspacer to 2'O-Methyl cytosine of another nucleotide sequence XCCXAC
gcggugggaaaugugagauggguugccgc

SEQ ID NO: 190 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker Hexaethyleneglycol spacer to 2'O-Methyl guanosine of another nucleotide sequence XCCXAC
gcggugggaaaugugagauggguugccgc

SEQ ID NO: 191 - RNA, 40 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  modified_base (35)..(35): gm
  modified_base (36)..(37): 2'O-Methyl Cytosine
  modified_base (38)..(38): gm
  modified_base (39)..(39): 2'O-Methyl Adenosine
  modified_base (40)..(40): 2'O-Methyl Cytosine
  misc_feature (40)..(40): The 2'O-Methyl cytosine is attached  through the linker 1,3-propanediolspacer to 2'O-Methyl cytosine of SEQ ID NO: 330
gcggugggaaaugugagauggguugccgcuuuuugccgac

SEQ ID NO: 192 - RNA, 45 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(39): 2'O-Methyl deoxyuridine
  misc_feature (30)..(39): 2'O-Methyl deoxyuridine linker
  modified_base (40)..(40): gm
  modified_base (41)..(42): 2'O-Methyl Cytosine
  modified_base (43)..(43): gm
  modified_base (44)..(44): 2'O-Methyl Adenosine
  modified_base (45)..(45): 2'O-Methyl Cytosine
  misc_feature (45)..(45): The 2'O-Methyl cytosine is attached  through the linker 1,3-propanediolspacer to 2'O-Methyl cytosine of SEQ ID NO: 331
gcggugggaaaugugagauggguugccgcuuuuuuuuuugccgac

SEQ ID NO: 193 - RNA, 33 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (25)..(26): inverted deoxythymidine incorporated at the 3'  end
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
gcgcggugggaaaugugagauggguugccgcgc

SEQ ID NO: 194 - RNA, 66 nt, Artificial Sequence
  aptamer
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(36): gm
  modified_base (37)..(37): 2'O-Methyl Cytosine
  modified_base (38)..(39): gm
  modified_base (40)..(40): um
  modified_base (41)..(43): 2' Fluoro Guanosine
  modified_base (44)..(46): 2'O-Methyl Adenosine
  modified_base (47)..(47): um
  modified_base (48)..(48): 2' Fluoro Guanosine
  modified_base (49)..(49): um
  modified_base (50)..(50): 2' Fluoro Guanosine
  modified_base (51)..(51): 2'O-Methyl Adenosine
  modified_base (52)..(52): 2' Fluoro Guanosine
  modified_base (53)..(53): 2'O-Methyl Adenosine
  modified_base (54)..(54): um
  modified_base (55)..(57): 2' Fluoro Guanosine
  modified_base (58)..(59): um
  modified_base (60)..(60): gm
  modified_base (61)..(62): 2'O-Methyl Cytosine
  modified_base (63)..(63): gm
  modified_base (64)..(64): 2'O-Methyl Cytosine
  modified_base (65)..(65): gm
  modified_base (66)..(66): 2'O-Methyl Cytosine
  modified_base (66)..(66): inverted deoxythymidine incorporated at the 3'  end
ccgcgcggagggguuucauaaucccguuugucggcgcggugggaaaugugagauggguugccgcgc

SEQ ID NO: 195 - RNA, 33 nt, Artificial Sequence; identical to SEQ ID NO: 1
  aptamer
  modified_base (1)..(2): 2'O-Methyl Adenosine
  modified_base (3)..(3): 2' Fluoro Guanosine
  modified_base (4)..(4): 2'O-Methyl Adenosine
  modified_base (5)..(5): 2' Fluoro Guanosine
  modified_base (6)..(6): 2'O-Methyl Adenosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Adenosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Adenosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Adenosine
  misc_feature (33)..(33): The 2'O-Methyl guanosine is attached  through the linker 1,3-propanediolspacer to 2'O-Methyl guanosine of SEQ ID NO: 332
  modified_base (33)..(33): gm

SEQ ID NO: 196 - RNA, 33 nt, Artificial Sequence; identical to SEQ ID NO: 1
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (33)..(33): The 2'O-Methyl guanosine is attached through the linker Hexaethyleneglycol spacer to 2'O-Methyl guanosine of  SEQ ID NO: 333

SEQ ID NO: 197 - RNA, 71 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (34)..(38): 2'O-Methyl deoxyuridine
  misc_feature (34)..(38): 2'O-Methyl deoxyuridine linker
  modified_base (39)..(39): gm
  modified_base (40)..(40): 2'O-Methyl Cytosine
  modified_base (41)..(41): gm
  modified_base (42)..(42): 2'O-Methyl Cytosine
  modified_base (43)..(44): gm
  modified_base (45)..(45): um
  modified_base (46)..(48): 2' Fluoro Guanosine
  modified_base (49)..(51): 2'O-Methyl Adenosine
  modified_base (52)..(52): um
  modified_base (53)..(53): 2' Fluoro Guanosine
  modified_base (54)..(54): um
  modified_base (55)..(55): 2' Fluoro Guanosine
  modified_base (56)..(56): 2'O-Methyl Adenosine
  modified_base (57)..(57): 2' Fluoro Guanosine
  modified_base (58)..(58): 2'O-Methyl Adenosine
  modified_base (59)..(59): um
  modified_base (60)..(62): 2' Fluoro Guanosine
  modified_base (63)..(64): um
  modified_base (65)..(65): gm
  modified_base (66)..(67): 2'O-Methyl Cytosine
  modified_base (68)..(68): gm
  modified_base (69)..(69): 2'O-Methyl Cytosine
  modified_base (70)..(70): gm
  modified_base (71)..(71): 2'O-Methyl Cytosine
ccgcgcggagggguuucauaaucccguuugucguuuuugcgcggugggaaaugugagauggguugccgcgc

SEQ ID NO: 198 - RNA, 76 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(18): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  misc_feature (34)..(43): 2'O-Methyl deoxyuridine linker
  modified_base (34)..(43): 2'O-Methyl deoxyuridine
  modified_base (44)..(44): gm
  modified_base (45)..(45): 2'O-Methyl Cytosine
  modified_base (46)..(46): gm
  modified_base (47)..(47): 2'O-Methyl Cytosine
  modified_base (48)..(49): gm
  modified_base (50)..(50): um
  modified_base (51)..(53): 2' Fluoro Guanosine
  modified_base (54)..(56): 2'O-Methyl Adenosine
  modified_base (57)..(57): um
  modified_base (58)..(58): 2' Fluoro Guanosine
  modified_base (59)..(59): um
  modified_base (60)..(60): 2' Fluoro Guanosine
  modified_base (61)..(61): 2'O-Methyl Adenosine
  modified_base (62)..(62): 2' Fluoro Guanosine
  modified_base (63)..(63): 2'O-Methyl Adenosine
  modified_base (64)..(64): um
  modified_base (65)..(67): 2' Fluoro Guanosine
  modified_base (70)..(70): gm
  modified_base (71)..(72): 2'O-Methyl Cytosine
  modified_base (73)..(73): gm
  modified_base (74)..(74): 2'O-Methyl Cytosine
  modified_base (75)..(75): gm
  modified_base (76)..(76): 2'O-Methyl Cytosine
ccgcgcggagggguuucauaaucccguuugucguuuuuuuuuugcgcggugggaaaugugagauggguugccgcgc

SEQ ID NO: 199 - RNA, 37 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (35)..(35): gm
  modified_base (36)..(36): 2'O-Methyl Adenosine
  modified_base (37)..(37): 2'O-Methyl Cytosine
  misc_feature (37)..(37): The 2'O-Methyl cytosine is attached  through the linker 1,3-propanediolspacer to 2'O-Methyl cytosine of SEQ ID NO: 334
gcgcggugggaaaugugagauggguugccgcgccgac

SEQ ID NO: 200 - RNA, 33 nt, Artificial Sequence; identical to SEQ ID NO: 193
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  misc_feature (33)..(33): The 2'O-Methyl cytosine is attached  through the linker 1,3-propanediolspacer to 2'O-Methyl cytosine of another nucleotide sequence CXAC

SEQ ID NO: 201 - RNA, 33 nt, Artificial Sequence; identical to SEQ ID NO: 193
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  misc_feature (33)..(33): The 2'O-Methyl cytosine is attached  through the linker Hexaethyleneglycol spacer to 2'O-Methyl cytosine of another nucleotide sequence CXAC

SEQ ID NO: 202 - RNA, 42 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(39): 2'O-Methyl Cytosine
  modified_base (40)..(40): gm
  modified_base (41)..(41): 2'O-Methyl Adenosine
  modified_base (42)..(42): 2'O-Methyl Cytosine
  misc_feature (42)..(42): The 2'O-Methyl cytosine is attached  through the linker 1,3-propanediolspacer to 2'O-Methyl cytosine of SEQ ID NO: 337
gcgcggugggaaaugugagauggguugccgcgcuuuuucgac

SEQ ID NO: 203 - RNA, 47 nt, Artificial Sequence
  aptamer
  modified_base (1)..(1): gm
  modified_base (2)..(2): 2'O-Methyl Cytosine
  modified_base (3)..(3): gm
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): 2'O-Methyl Cytosine
  modified_base (45)..(45): gm
  modified_base (46)..(46): 2'O-Methyl Adenosine
  modified_base (47)..(47): 2'O-Methyl Cytosine
  misc_feature (47)..(47): The 2'O-Methyl cytosine is attached  through the linker 1,3-propanediolspacer to 2'O-Methyl cytosine of SEQ ID NO: 338
gcgcggugggaaaugugagauggguugccgcgcuuuuuuuuuucgac

SEQ ID NO: 204 - RNA, 68 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(36): gm
  modified_base (37)..(37): 2'O-Methyl Cytosine
  modified_base (38)..(38): gm
  modified_base (39)..(39): 2'O-Methyl Cytosine
  modified_base (40)..(41): gm
  modified_base (42)..(42): um
  modified_base (43)..(45): 2' Fluoro Guanosine
  modified_base (46)..(48): 2'O-Methyl Adenosine
  modified_base (49)..(49): um
  modified_base (50)..(50): 2' Fluoro Guanosine
  modified_base (51)..(51): um
  modified_base (52)..(52): 2' Fluoro Guanosine
  modified_base (53)..(53): 2'O-Methyl Adenosine
  modified_base (54)..(54): 2' Fluoro Guanosine
  modified_base (55)..(55): 2'O-Methyl Adenosine
  modified_base (56)..(56): um
  modified_base (57)..(59): 2' Fluoro Guanosine
  modified_base (60)..(61): um
  modified_base (62)..(62): gm
  modified_base (63)..(64): 2'O-Methyl Cytosine
  modified_base (65)..(65): gm
  modified_base (66)..(66): 2'O-Methyl Cytosine
  modified_base (67)..(67): gm
  modified_base (68)..(68): 2'O-Methyl Cytosine
ccgcgcggagggguuucauaaucccguuugucggcgcgcggugggaaaugugagauggguugccgcgc

SEQ ID NO: 205 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (35)..(35): The 2'O-Methyl cytosine is attached  through the linker 1,3-propanediolspacer to 2'O-Methyl guanosine of SEQ ID NO: 339

SEQ ID NO: 206 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  misc_feature (35)..(35): The 2'O-Methyl cytosine is attached through the linker hexaethylene glycol spacer to 2'O-Methyl guanosine of SEQ ID NO:340

SEQ ID NO: 207 - RNA, 73 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(40): 2'O-Methyl deoxyuridine
  misc_feature (36)..(40): 2'O-Methyl deoxyuridine linker
  modified_base (41)..(41): gm
  modified_base (42)..(42): 2'O-Methyl Cytosine
  modified_base (43)..(43): gm
  modified_base (44)..(44): 2'O-Methyl Cytosine
  modified_base (45)..(46): gm
  modified_base (47)..(47): um
  modified_base (48)..(50): 2' Fluoro Guanosine
  modified_base (51)..(53): 2'O-Methyl Adenosine
  modified_base (54)..(54): um
  modified_base (55)..(55): 2' Fluoro Guanosine
  modified_base (56)..(56): um
  modified_base (57)..(57): 2' Fluoro Guanosine
  modified_base (58)..(58): 2'O-Methyl Adenosine
  modified_base (59)..(59): 2' Fluoro Guanosine
  modified_base (60)..(60): 2'O-Methyl Adenosine
  modified_base (61)..(61): um
  modified_base (62)..(64): 2' Fluoro Guanosine
  modified_base (65)..(66): um
  modified_base (67)..(67): gm
  modified_base (68)..(69): 2'O-Methyl Cytosine
  modified_base (70)..(70): gm
  modified_base (71)..(71): 2'O-Methyl Cytosine
  modified_base (72)..(72): gm
  modified_base (73)..(73): 2'O-Methyl Cytosine
  modified_base (73)..(73): inverted deoxythymidine incorporated at the 3'  end
ccgcgcggagggguuucauaaucccguuugucggcuuuuugcgcggugggaaaugugagauggguugccgcgc

SEQ ID NO: 208 - RNA, 78 nt, Artificial Sequence
  aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (36)..(45): 2'O-Methyl deoxyuridine
  misc_feature (36)..(45): 2'O-Methyl deoxyuridine linker
  modified_base (46)..(46): gm
  modified_base (47)..(47): 2'O-Methyl Cytosine
  modified_base (48)..(48): gm
  modified_base (49)..(49): 2'O-Methyl Cytosine
  modified_base (50)..(51): gm
  modified_base (52)..(52): um
  modified_base (53)..(55): 2' Fluoro Guanosine
  modified_base (56)..(58): 2'O-Methyl Adenosine
  modified_base (59)..(59): um
  modified_base (60)..(60): 2' Fluoro Guanosine
  modified_base (61)..(61): um
  modified_base (62)..(62): 2' Fluoro Guanosine
  modified_base (63)..(63): 2'O-Methyl Adenosine
  modified_base (64)..(64): 2' Fluoro Guanosine
  modified_base (65)..(65): 2'O-Methyl Adenosine
  modified_base (66)..(66): um
  modified_base (67)..(69): 2' Fluoro Guanosine
  modified_base (70)..(71): um
  modified_base (72)..(72): gm
  modified_base (73)..(74): 2'O-Methyl Cytosine
  modified_base (75)..(75): gm
  modified_base (76)..(76): 2'O-Methyl Cytosine
  modified_base (77)..(77): gm
  modified_base (78)..(78): 2'O-Methyl Cytosine
  modified_base (78)..(78): inverted deoxythymidine incorporated at the 3'  end
ccgcgcggagggguuucauaaucccguuugucggcuuuuuuuuuugcgcggugggaaaugugagauggguugccgcgc

SEQ ID NO: 209 - RNA, 39 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (4)..(5): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  misc_feature (39)..(39): The 2'O-Methyl cytosine is attached  through the linker 1,3-propanediolspacer to 2'O-Methyl cytosine of SEQ ID NO: 341
gcgcggugggaaaugugagauggguugccgcgcgccgac

SEQ ID NO: 210 - RNA, 33 nt, Artificial Sequence; identical to SEQ ID NO: 193
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  misc_feature (33)..(33): The 2'O-Methyl cytosine is attached  through the linker 1,3-propanediolspacer to 2'O-Methyl guanosine of another nucleotide sequence XCCXAC

SEQ ID NO: 211 - RNA, 33 nt, Artificial Sequence; identical to SEQ ID NO: 193
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  misc_feature (33)..(33): The 2'O-Methyl cytosine is attached  through the linker Hexaethyleneglycol spacer to 2'O-Methyl guanosine of another nucleotide sequence XCCXAC

SEQ ID NO: 212 - RNA, 44 nt, Artificial Sequence
  aptamer
  modified_base (1)..(1): gm
  modified_base (2)..(2): 2'O-Methyl Cytosine
  modified_base (2)..(2): gm
  modified_base (4)..(4): 2'O-Methyl Cytosine
  modified_base (4)..(5): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  misc_feature (44)..(44): The 2'O-Methyl cytosine is attached  through the linker 1,3-propanediolspacer to 2'O-Methyl cytosine of SEQ ID NO: 344
gcgcggugggaaaugugagauggguugccgcgcuuuuugccgac

SEQ ID NO: 213 - RNA, 49 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): gm
  modified_base (45)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  misc_feature (49)..(49): The 2'O-Methyl cytosine is attached  through the linker 1,3-propanediolspacer to 2'O-Methyl cytosine of SEQ ID NO: 345
gcgcggugggaaaugugagauggguugccgcgcuuuuuuuuuugccgac

SEQ ID NO: 214 - RNA, 36 nt, Artificial Sequence; identical to SEQ ID NO: 9
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  misc_feature (36)..(36): inverted deoxythymidine incorporated at the 3'  end

SEQ ID NO: 215 - RNA, 36 nt, Artificial Sequence; identical to SEQ ID NO: 9
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(34): um
  modified_base (33)..(33): gm
  modified_base (35)..(35): 2'O-Methyl Cytosine
  modified_base (36)..(36): gm
  misc_feature (36)..(36): The 2'O-Methyl guanosine is attached  through the linker 1,3-propanediolspacer to 2'O-Methyl guanosine of SEQ ID NO: 346

SEQ ID NO: 216 - RNA, 36 nt, Artificial Sequence; identical to SEQ ID NO: 9
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(34): um
  modified_base (33)..(33): gm
  modified_base (35)..(35): 2'O-Methyl Cytosine
  modified_base (36)..(36): gm
  misc_feature (36)..(36): The 2'O-Methyl guanosine is attached through the linker Hexaethyleneglycol spacer to 2'O-Methyl guanosine of  SEQ ID NO: 347

SEQ ID NO: 217 - RNA, 70 nt, Artificial Sequence
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  modified_base (37)..(41): 2'O-Methyl deoxyuridine
  misc_feature (37)..(41): 2'O-Methyl deoxyuridine linker
  modified_base (42)..(42): gm
  modified_base (43)..(43): 2'O-Methyl Cytosine
  modified_base (44)..(45): gm
  modified_base (46)..(46): um
  modified_base (47)..(49): 2' Fluoro Guanosine
  modified_base (50)..(52): 2'O-Methyl Adenosine
  modified_base (53)..(53): um
  modified_base (54)..(54): 2' Fluoro Guanosine
  modified_base (55)..(55): um
  modified_base (56)..(56): 2' Fluoro Guanosine
  modified_base (57)..(57): 2'O-Methyl Adenosine
  modified_base (58)..(58): 2' Fluoro Guanosine
  modified_base (59)..(59): 2'O-Methyl Adenosine
  modified_base (60)..(60): um
  modified_base (61)..(63): 2' Fluoro Guanosine
  modified_base (64)..(65): um
  modified_base (66)..(66): gm
  modified_base (67)..(68): 2'O-Methyl Cytosine
  modified_base (69)..(69): gm
  modified_base (70)..(70): 2'O-Methyl Cytosine
  misc_feature (70)..(70): inverted deoxythymidine incorporated at the 3'  end
cgacuccgcgcggaggcuugagguagccguuugucguuuuugcggugggaaaugugagauggguugccgc

SEQ ID NO: 218 - RNA, 75 nt, Artificial Sequence
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(34): um
  modified_base (30)..(32): um
  modified_base (33)..(33): gm
  modified_base (34)..(34): um
  modified_base (35)..(35): 2'O-Methyl Cytosine
  modified_base (36)..(36): gm
  modified_base (37)..(46): 2'O-Methyl deoxyuridine
  modified_base (37)..(46): 2'O-Methyl deoxyuridine linker
  modified_base (47)..(47): gm
  modified_base (48)..(48): 2'O-Methyl Cytosine
  modified_base (49)..(50): gm
  modified_base (51)..(51): um
  modified_base (52)..(54): 2' Fluoro Guanosine
  modified_base (55)..(57): 2'O-Methyl Adenosine
  modified_base (58)..(58): um
  modified_base (59)..(59): 2' Fluoro Guanosine
  modified_base (60)..(60): um
  modified_base (61)..(61): 2' Fluoro Guanosine
  modified_base (62)..(62): 2'O-Methyl Adenosine
  modified_base (63)..(63): 2' Fluoro Guanosine
  modified_base (64)..(64): 2'O-Methyl Adenosine
  modified_base (65)..(65): um
  modified_base (66)..(68): 2' Fluoro Guanosine
  modified_base (69)..(70): um
  modified_base (71)..(71): gm
  modified_base (72)..(73): 2'O-Methyl Cytosine
  modified_base (74)..(74): gm
  modified_base (75)..(75): 2'O-Methyl Cytosine
  modified_base (75)..(75): inverted deoxythymidine incorporated at the 3'  end
cgacuccgcgcggaggcuugagguagccguuugucguuuuuuuuuugcggugggaaaugugagauggguugccgc

SEQ ID NO: 219 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 220 - RNA, 29 nt, Artificial Sequence
  aptamer
  modified_base (1)..(1): gm
  modified_base (2)..(2): 2'O-Methyl Cytosine
  modified_base (2)..(3): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached  through the linker 1,3-propanediolspacer to 2'O-Methyl cytosine of SEQ ID NO: 348
gcggugggaaaugugagauggguugccgc

SEQ ID NO: 221 - RNA, 70 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  misc_feature (30)..(34): 2'O-Methyl deoxyuridine linker
  modified_base (35)..(35): 2'O-Methyl Cytosine
  modified_base (36)..(36): gm
  modified_base (37)..(37): 2'O-Methyl Adenosine
  modified_base (38)..(38): 2'O-Methyl Cytosine
  modified_base (39)..(39): um
  modified_base (40)..(43): 2'O-Methyl Cytosine
  modified_base (42)..(42): 2' Fluoro Guanosine
  modified_base (44)..(44): 2' Fluoro Guanosine
  modified_base (45)..(45): 2'O-Methyl Cytosine
  modified_base (46)..(47): 2' Fluoro Guanosine
  modified_base (48)..(48): 2'O-Methyl Adenosine
  modified_base (49)..(50): 2' Fluoro Guanosine
  modified_base (51)..(51): 2'O-Methyl Cytosine
  modified_base (52)..(53): um
  modified_base (54)..(54): 2' Fluoro Guanosine
  modified_base (55)..(55): 2'O-Methyl Adenosine
  modified_base (56)..(57): 2' Fluoro Guanosine
  modified_base (58)..(58): um
  modified_base (59)..(59): 2'O-Methyl Adenosine
  modified_base (60)..(60): 2' Fluoro Guanosine
  modified_base (61)..(62): 2'O-Methyl Cytosine
  modified_base (63)..(63): 2' Fluoro Guanosine
  modified_base (64)..(67): um
  modified_base (67)..(67): gm
  modified_base (68)..(68): um
  modified_base (69)..(69): 2'O-Methyl Cytosine
  modified_base (70)..(70): gm
  modified_base (70)..(70): inverted deoxythymidine incorporated at the 3'  end
gcggugggaaaugugagauggguugccgcuuuuucgacuccgcgcggaggcuugagguagccguuugucg

SEQ ID NO: 222 - RNA, 75 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(39): 2'O-Methyl deoxyuridine
  misc_feature (30)..(39): 2'O-Methyl deoxyuridine linker
  modified_base (40)..(40): 2'O-Methyl Cytosine
  modified_base (41)..(41): gm
  modified_base (42)..(42): 2'O-Methyl Adenosine
  modified_base (43)..(43): 2'O-Methyl Cytosine
  modified_base (44)..(44): um
  modified_base (45)..(46): 2'O-Methyl Cytosine
  modified_base (47)..(47): 2' Fluoro Guanosine
  modified_base (48)..(48): 2'O-Methyl Cytosine
  modified_base (49)..(49): 2' Fluoro Guanosine
  modified_base (50)..(50): 2'O-Methyl Cytosine
  modified_base (51)..(52): 2' Fluoro Guanosine
  modified_base (53)..(53): 2'O-Methyl Adenosine
  modified_base (54)..(55): 2' Fluoro Guanosine
  modified_base (56)..(56): 2'O-Methyl Cytosine
  modified_base (57)..(58): um
  modified_base (59)..(59): 2' Fluoro Guanosine
  modified_base (60)..(60): 2'O-Methyl Adenosine
  modified_base (61)..(62): 2' Fluoro Guanosine
  modified_base (63)..(63): um
  modified_base (64)..(64): 2'O-Methyl Adenosine
  modified_base (65)..(65): 2' Fluoro Guanosine
  modified_base (66)..(67): 2'O-Methyl Cytosine
  modified_base (68)..(68): 2' Fluoro Guanosine
  modified_base (69)..(71): um
  modified_base (72)..(72): gm
  modified_base (73)..(73): um
  modified_base (74)..(74): 2'O-Methyl Cytosine
  modified_base (75)..(75): gm
  modified_base (75)..(75): inverted deoxythymidine incorporated at the 3'  end
gcggugggaaaugugagauggguugccgcuuuuuuuuuucgacuccgcgcggaggcuugagguagccguuugucg

SEQ ID NO: 223 - RNA, 65 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(30): 2'O-Methyl Cytosine
  modified_base (31)..(31): gm
  modified_base (32)..(32): 2'O-Methyl Adenosine
  modified_base (33)..(33): 2'O-Methyl Cytosine
  modified_base (34)..(34): um
  modified_base (35)..(36): 2'O-Methyl Cytosine
  modified_base (37)..(37): 2' Fluoro Guanosine
  modified_base (38)..(38): 2'O-Methyl Cytosine
  modified_base (40)..(40): 2'O-Methyl Cytosine
  modified_base (43)..(43): 2'O-Methyl Adenosine
  modified_base (46)..(46): 2'O-Methyl Cytosine
  modified_base (47)..(48): um
  modified_base (49)..(49): 2' Fluoro Guanosine
  modified_base (50)..(50): 2'O-Methyl Adenosine
  modified_base (51)..(52): 2' Fluoro Guanosine
  modified_base (53)..(53): um
  modified_base (54)..(54): 2'O-Methyl Adenosine
  modified_base (55)..(55): 2' Fluoro Guanosine
  modified_base (56)..(57): 2'O-Methyl Cytosine
  modified_base (58)..(58): 2' Fluoro Guanosine
  modified_base (59)..(61): um
  modified_base (62)..(62): gm
  modified_base (63)..(63): um
  modified_base (64)..(64): 2'O-Methyl Cytosine
  modified_base (65)..(65): gm
  modified_base (65)..(65): inverted deoxythymidine incorporated at the 3'  end
gcggugggaaaugugagauggguugccgccgacuccgcgcggaggcuugagguagccguuugucg

SEQ ID NO: 224 - RNA, 69 nt, Artificial Sequence
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(41): gm
  modified_base (42)..(42): 2'O-Methyl Cytosine
  modified_base (43)..(44): gm
  modified_base (45)..(45): um
  modified_base (46)..(48): 2' Fluoro Guanosine
  modified_base (49)..(51): 2'O-Methyl Adenosine
  modified_base (52)..(52): um
  modified_base (53)..(53): 2' Fluoro Guanosine
  modified_base (54)..(54): um
  modified_base (55)..(55): 2' Fluoro Guanosine
  modified_base (56)..(56): 2'O-Methyl Adenosine
  modified_base (57)..(57): 2' Fluoro Guanosine
  modified_base (58)..(58): 2'O-Methyl Adenosine
  modified_base (59)..(59): um
  modified_base (60)..(62): 2' Fluoro Guanosine
  modified_base (63)..(64): um
  modified_base (65)..(65): gm
  modified_base (65)..(65): gm
  modified_base (66)..(67): 2'O-Methyl Cytosine
  modified_base (68)..(68): gm
  modified_base (69)..(69): 2'O-Methyl Cytosine
  modified_base (69)..(69): inverted deoxythymidine incorporated at the 3'  end
gccgacuccgcgcggaggcuugagguagccguuugucggcgcggugggaaaugugagauggguugccgc

SEQ ID NO: 225 - RNA, 40 nt, Artificial Sequence; identical to SEQ ID NO: 110
  aptamer
  modified_base (1)..(1): gm
  modified_base (2)..(3): 2'O-Methyl Cytosin
  modified_base (4)..(4): gm
  modified_base (5)..(5): 2'O-Methyl Adenosine
  modified_base (6)..(6): 2'O-Methyl Cytosin
  modified_base (7)..(7): um
  modified_base (8)..(9): 2'O-Methyl Cytosin
  modified_base (10)..(10): 2' Fluoro Guanosine
  modified_base (11)..(11): 2'O-Methyl Cytosin
  modified_base (12)..(12): 2' Fluoro Guanosine
  modified_base (13)..(13): 2'O-Methyl Cytosin
  modified_base (14)..(15): 2' Fluoro Guanosine
  modified_base (16)..(16): 2'O-Methyl Adenosine
  modified_base (17)..(18): 2' Fluoro Guanosine
  modified_base (17)..(18): 2' Fluoro Guanosine
  modified_base (19)..(19): 2'O-Methyl Cytosin
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosin
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosin
  modified_base (38)..(39): gm
  modified_base (40)..(40): 2'O-Methyl Cytosin
  misc_feature (40)..(40): The 2'O-Methyl cytosine is attached  through the linker 1,3-propanediolspacer to 2'O-Methyl guanosine of SEQ ID NO: 351

SEQ ID NO: 226 - RNA, 40 nt, Artificial Sequence; identical to SEQ ID NO: 110
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (22)..(22): 2' Fluoro Guanosine
  modified_base (23)..(23): 2'O-Methyl Adenosine
  modified_base (24)..(25): 2' Fluoro Guanosine
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (35)..(35): gm
  modified_base (37)..(37): 2'O-Methyl Cytosine
  modified_base (38)..(39): gm
  modified_base (40)..(40): 2'O-Methyl Cytosine
  misc_feature (40)..(40): The 2'O-Methyl cytosine is attached through the linker Hexaethylene glycol spacer to 2'O-Methyl guanosine of SEQ ID NO:352

SEQ ID NO: 227 - RNA, 74 nt, Artificial Sequence
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(45): 2'O-Methyl deoxyuridine linker
  modified_base (41)..(45): 2'O-Methyl deoxyuridine
  modified_base (46)..(46): gm
  modified_base (47)..(47): 2'O-Methyl Cytosine
  modified_base (48)..(49): gm
  modified_base (50)..(50): um
  modified_base (51)..(53): 2' Fluoro Guanosine
  modified_base (54)..(56): 2'O-Methyl Adenosine
  modified_base (57)..(57): um
  modified_base (58)..(58): 2' Fluoro Guanosine
  modified_base (59)..(59): um
  modified_base (60)..(60): 2' Fluoro Guanosine
  modified_base (61)..(61): 2'O-Methyl Adenosine
  modified_base (62)..(62): 2' Fluoro Guanosine
  modified_base (63)..(63): 2'O-Methyl Adenosine
  modified_base (64)..(64): um
  modified_base (65)..(67): 2' Fluoro Guanosine
  modified_base (68)..(69): um
  modified_base (70)..(70): gm
  modified_base (71)..(72): 2'O-Methyl Cytosine
  modified_base (73)..(73): gm
  modified_base (74)..(74): 2'O-Methyl Cytosine
  modified_base (74)..(74): inverted deoxythymidine incorporated at the 3'  end
gccgacuccgcgcggaggcuugagguagccguuugucggcuuuuugcggugggaaaugugagauggguugccgc

SEQ ID NO: 228 - RNA, 79 nt, Artificial Sequence
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(50): 2'O-Methyl deoxyuridine
  modified_base (41)..(50): 2'O-Methyl deoxyuridine linker
  modified_base (51)..(51): gm
  modified_base (52)..(52): 2'O-Methyl Cytosine
  modified_base (53)..(54): gm
  modified_base (55)..(55): um
  modified_base (56)..(58): 2' Fluoro Guanosine
  modified_base (59)..(61): 2'O-Methyl Adenosine
  modified_base (62)..(62): um
  modified_base (63)..(63): 2' Fluoro Guanosine
  modified_base (64)..(64): um
  modified_base (65)..(65): 2' Fluoro Guanosine
  modified_base (66)..(66): 2'O-Methyl Adenosine
  modified_base (67)..(67): 2' Fluoro Guanosine
  modified_base (68)..(68): 2'O-Methyl Adenosine
  modified_base (69)..(69): um
  modified_base (70)..(72): 2' Fluoro Guanosine
  modified_base (73)..(74): um
  modified_base (75)..(75): gm
  modified_base (76)..(77): 2'O-Methyl Cytosine
  modified_base (78)..(78): gm
  modified_base (79)..(79): 2'O-Methyl Cytosine
  modified_base (79)..(79): inverted deoxythymidine incorporated at the 3'  end
gccgacuccgcgcggaggcuugagguagccguuugucggcuuuuuuuuuugcggugggaaaugugagauggguugccgc

SEQ ID NO: 229 - RNA, 69 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(30): gm
  modified_base (31)..(32): 2'O-Methyl Cytosine
  modified_base (33)..(33): gm
  modified_base (34)..(34): 2'O-Methyl Adenosine
  modified_base (35)..(35): 2'O-Methyl Cytosine
  modified_base (36)..(36): um
  modified_base (37)..(38): 2'O-Methyl Cytosine
  modified_base (39)..(39): 2' Fluoro Guanosine
  modified_base (40)..(40): 2'O-Methyl Cytosine
  modified_base (41)..(41): 2' Fluoro Guanosine
  modified_base (42)..(42): 2'O-Methyl Cytosine
  modified_base (43)..(44): 2' Fluoro Guanosine
  modified_base (45)..(45): 2'O-Methyl Adenosine
  modified_base (46)..(47): 2' Fluoro Guanosine
  modified_base (48)..(48): 2'O-Methyl Cytosine
  modified_base (49)..(50): um
  modified_base (51)..(51): 2' Fluoro Guanosine
  modified_base (52)..(52): 2'O-Methyl Adenosine
  modified_base (53)..(54): 2' Fluoro Guanosine
  modified_base (55)..(55): um
  modified_base (56)..(56): 2'O-Methyl Adenosine
  modified_base (57)..(57): 2' Fluoro Guanosine
  modified_base (58)..(59): 2'O-Methyl Cytosine
  modified_base (60)..(60): 2' Fluoro Guanosine
  modified_base (61)..(63): um
  modified_base (64)..(64): gm
  modified_base (65)..(65): um
  modified_base (66)..(66): 2'O-Methyl Cytosine
  modified_base (67)..(68): gm
  modified_base (69)..(69): 2'O-Methyl Cytosine
  modified_base (69)..(69): inverted deoxythymidine incorporated at the 3'  end
gcggugggaaaugugagauggguugccgcgccgacuccgcgcggaggcuugagguagccguuugucggc

SEQ ID NO: 230 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached  through the linker 1,3-propanediolspacer to 2'O-Methyl guanosine of SEQ ID NO: 353
gcggugggaaaugugagauggguugccgc

SEQ ID NO: 231 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker Hexaethylene glycol spacer to 2'O-Methyl guanosine of SEQ ID NO:354
gcggugggaaaugugagauggguugccgc

SEQ ID NO: 232 - RNA, 74 nt, Artificial Sequence
  aptamer
  modified_base (1)..(1): gm
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  modified_base (35)..(35): gm
  modified_base (36)..(37): 2'O-Methyl Cytosine
  modified_base (38)..(38): gm
  modified_base (39)..(39): 2'O-Methyl Adenosine
  modified_base (40)..(40): 2'O-Methyl Cytosine
  modified_base (41)..(41): um
  modified_base (42)..(43): 2'O-Methyl Cytosine
  modified_base (44)..(44): 2' Fluoro Guanosine
  modified_base (45)..(45): 2'O-Methyl Cytosine
  modified_base (46)..(46): 2' Fluoro Guanosine
  modified_base (47)..(47): 2'O-Methyl Cytosine
  modified_base (48)..(49): 2' Fluoro Guanosine
  modified_base (50)..(50): 2'O-Methyl Adenosine
  modified_base (51)..(52): 2' Fluoro Guanosine
  modified_base (53)..(53): 2'O-Methyl Cytosine
  modified_base (54)..(55): um
  modified_base (56)..(56): 2' Fluoro Guanosine
  modified_base (57)..(57): 2'O-Methyl Adenosine
  modified_base (58)..(59): 2' Fluoro Guanosine
  modified_base (60)..(60): um
  modified_base (61)..(61): 2'O-Methyl Adenosine
  modified_base (62)..(62): 2' Fluoro Guanosine
  modified_base (63)..(64): 2'O-Methyl Cytosine
  modified_base (65)..(65): 2' Fluoro Guanosine
  modified_base (66)..(68): um
  modified_base (69)..(69): gm
  modified_base (70)..(70): um
  modified_base (71)..(71): 2'O-Methyl Cytosine
  modified_base (72)..(73): gm
  modified_base (74)..(74): 2'O-Methyl Cytosine
  modified_base (74)..(74): inverted deoxythymidine incorporated at the 3'  end
gcggugggaaaugugagauggguugccgcuuuuugccgacuccgcgcggaggcuugagguagccguuugucggc

SEQ ID NO: 233 - RNA, 79 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (30)..(39): 2'O-Methyl deoxyuridine linker
  modified_base (30)..(39): 2'O-Methyl deoxyuridine
  modified_base (40)..(40): gm
  modified_base (41)..(42): 2'O-Methyl Cytosine
  modified_base (43)..(43): gm
  modified_base (44)..(44): 2'O-Methyl Adenosine
  modified_base (45)..(45): 2'O-Methyl Cytosine
  modified_base (46)..(46): um
  modified_base (47)..(48): 2'O-Methyl Cytosine
  modified_base (49)..(49): 2' Fluoro Guanosine
  modified_base (50)..(50): 2'O-Methyl Cytosine
  modified_base (51)..(51): 2' Fluoro Guanosine
  modified_base (52)..(52): 2'O-Methyl Cytosine
  modified_base (53)..(54): 2' Fluoro Guanosine
  modified_base (55)..(55): 2'O-Methyl Adenosine
  modified_base (56)..(57): 2' Fluoro Guanosine
  modified_base (58)..(58): 2'O-Methyl Cytosine
  modified_base (59)..(60): um
  modified_base (61)..(61): 2' Fluoro Guanosine
  modified_base (62)..(62): 2'O-Methyl Adenosine
  modified_base (63)..(64): 2' Fluoro Guanosine
  modified_base (65)..(65): um
  modified_base (66)..(66): 2'O-Methyl Adenosine
  modified_base (67)..(67): 2' Fluoro Guanosine
  modified_base (68)..(69): 2'O-Methyl Cytosine
  modified_base (70)..(70): 2' Fluoro Guanosine
  modified_base (71)..(73): um
  modified_base (74)..(74): gm
  modified_base (75)..(75): um
  modified_base (76)..(76): 2'O-Methyl Cytosine
  modified_base (78)..(79): gm
  modified_base (79)..(79): inverted deoxythymidine incorporated at the 3'  end
  modified_base (79)..(79): 2'O-Methyl Cytosine
gcggugggaaaugugagauggguugccgcuuuuuuuuuugccgacuccgcgcggaggcuugagguagccguuugucggc

SEQ ID NO: 234 - RNA, 69 nt, Artificial Sequence
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): gm
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): gm
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): gm
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): gm
  modified_base (33)..(33): gm
  modified_base (34)..(34): gm
  modified_base (35)..(35): 2'O-Methyl Cytosine
  modified_base (36)..(37): gm
  modified_base (38)..(38): 2'O-Methyl Cytosine
  modified_base (39)..(39): gm
  modified_base (40)..(40): 2'O-Methyl Cytosine
  modified_base (41)..(42): gm
  modified_base (43)..(43): gm
  modified_base (44)..(46): 2' Fluoro Guanosine
  modified_base (47)..(49): 2'O-Methyl Adenosine
  modified_base (50)..(50): gm
  modified_base (51)..(51): 2' Fluoro Guanosine
  modified_base (52)..(52): gm
  modified_base (53)..(53): 2' Fluoro Guanosine
  modified_base (54)..(54): 2'O-Methyl Adenosine
  modified_base (55)..(55): 2' Fluoro Guanosine
  modified_base (56)..(56): 2'O-Methyl Adenosine
  modified_base (57)..(57): gm
  modified_base (58)..(60): 2' Fluoro Guanosine
  modified_base (61)..(62): gm
  modified_base (63)..(63): gm
  modified_base (64)..(65): 2'O-Methyl Cytosine
  modified_base (66)..(66): gm
  modified_base (67)..(67): 2'O-Methyl Cytosine
  modified_base (68)..(68): gm
  modified_base (69)..(69): 2'O-Methyl Cytosine
  modified_base (69)..(69): inverted deoxythymidine incorporated at the 3'  end
cgacuccgcgcggaggcuugagguagccguuugucggcgcggugggaaaugugagauggguugccgcgc

SEQ ID NO: 235 - RNA, 36 nt, Artificial Sequence; identical to SEQ ID NO: 9
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (29)..(29): gm
  modified_base (30)..(32): um
  modified_base (33)..(33): gm
  modified_base (34)..(34): um
  modified_base (35)..(35): 2'O-Methyl Cytosine
  misc_feature (36)..(36): The 2'O-Methyl guanosine is attached  through the linker 1,3-propanediolspacer to 2'O-Methyl guanosine of SEQ ID NO: 355

SEQ ID NO: 236 - RNA, 36 nt, Artificial Sequence; identical to SEQ ID NO: 9
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2'O-Methyl Cytosine
  modified_base (9)..(9): 2'O-Methyl Cytosine
  modified_base (10)..(10): 2'O-Methyl Cytosine
  modified_base (11)..(11): 2'O-Methyl Cytosine
  modified_base (12)..(13): 2'O-Methyl Cytosine
  modified_base (14)..(14): 2'O-Methyl Adenosine
  modified_base (15)..(16): 2'O-Methyl Cytosine
  modified_base (17)..(17): 2'O-Methyl Cytosine
  modified_base (18)..(19): um
  modified_base (20)..(20): 2'O-Methyl Cytosine
  modified_base (21)..(21): 2'O-Methyl Adenosine
  modified_base (22)..(23): 2'O-Methyl Cytosine
  modified_base (24)..(24): um
  modified_base (25)..(25): 2'O-Methyl Adenosine
  modified_base (26)..(26): 2'O-Methyl Cytosine
  modified_base (27)..(28): 2'O-Methyl Cytosine
  modified_base (29)..(29): 2'O-Methyl Cytosine
  modified_base (30)..(32): um
  modified_base (33)..(33): gm
  modified_base (34)..(34): um
  modified_base (35)..(35): 2'O-Methyl Cytosine
  modified_base (36)..(36): gm
  misc_feature (36)..(36): The 2'O-Methyl guanosine is attached through the linker Hexaethylene glycol spacer to 2'O-Methyl guanosine of SEQ ID NO:356

SEQ ID NO: 237 - RNA, 74 nt, Artificial Sequence
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  modified_base (37)..(41): 2'O-Methyl deoxyuridine
  misc_feature (37)..(41): 2'O-Methyl deoxyuridine linker
  modified_base (42)..(42): gm
  modified_base (43)..(43): 2'O-Methyl Cytosine
  modified_base (44)..(44): gm
  modified_base (45)..(45): 2'O-Methyl Cytosine
  modified_base (46)..(47): gm
  modified_base (48)..(48): um
  modified_base (49)..(51): 2' Fluoro Guanosine
  modified_base (52)..(54): 2'O-Methyl Adenosine
  modified_base (55)..(55): um
  modified_base (56)..(56): 2' Fluoro Guanosine
  modified_base (57)..(57): um
  modified_base (58)..(58): 2' Fluoro Guanosine
  modified_base (59)..(59): 2'O-Methyl Adenosine
  modified_base (60)..(60): 2' Fluoro Guanosine
  modified_base (61)..(61): 2'O-Methyl Adenosine
  modified_base (62)..(62): um
  modified_base (63)..(65): 2' Fluoro Guanosine
  modified_base (66)..(67): um
  modified_base (68)..(68): gm
  modified_base (69)..(70): 2'O-Methyl Cytosine
  modified_base (71)..(71): gm
  modified_base (72)..(72): 2'O-Methyl Cytosine
  modified_base (73)..(73): gm
  modified_base (74)..(74): 2'O-Methyl Cytosine
  modified_base (74)..(74): inverted deoxythymidine incorporated at the 3'  end
cgacuccgcgcggaggcuugagguagccguuugucguuuuugcgcggugggaaaugugagauggguugccgcgc

SEQ ID NO: 238 - RNA, 79 nt, Artificial Sequence
  aptamer
  modified_base (1)..(1): 2'O-Methyl Cytosine
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  modified_base (37)..(46): 2'O-Methyl deoxyuridine
  misc_feature (37)..(46): 2'O-Methyl deoxyuridine linker
  modified_base (47)..(47): gm
  modified_base (48)..(48): 2'O-Methyl Cytosine
  modified_base (49)..(49): gm
  modified_base (50)..(50): 2'O-Methyl Cytosine
  modified_base (51)..(52): gm
  modified_base (53)..(53): um
  modified_base (54)..(56): 2' Fluoro Guanosine
  modified_base (57)..(59): 2'O-Methyl Adenosine
  modified_base (60)..(60): um
  modified_base (61)..(61): 2' Fluoro Guanosine
  modified_base (62)..(62): um
  modified_base (63)..(63): 2' Fluoro Guanosine
  modified_base (64)..(64): 2'O-Methyl Adenosine
  modified_base (65)..(65): 2' Fluoro Guanosine
  modified_base (66)..(66): 2'O-Methyl Adenosine
  modified_base (67)..(67): um
  modified_base (68)..(70): 2' Fluoro Guanosine
  modified_base (71)..(72): um
  modified_base (73)..(73): gm
  modified_base (74)..(75): 2'O-Methyl Cytosine
  modified_base (76)..(76): gm
  modified_base (77)..(77): 2'O-Methyl Cytosine
  modified_base (78)..(78): gm
  modified_base (79)..(79): 2'O-Methyl Cytosine
  modified_base (79)..(79): inverted deoxythymidine incorporated at the 3'  end
cgacuccgcgcggaggcuugagguagccguuugucguuuuuuuuuugcgcggugggaaaugugagauggguugccgcgc

SEQ ID NO: 239 - RNA, 69 nt, Artificial Sequence; identical to SEQ ID NO: 229
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(30): gm
  modified_base (31)..(32): 2'O-Methyl Cytosine
  modified_base (33)..(33): gm
  modified_base (34)..(34): 2'O-Methyl Adenosine
  modified_base (35)..(35): 2'O-Methyl Cytosine
  modified_base (36)..(36): um
  modified_base (37)..(38): 2'O-Methyl Cytosine
  modified_base (39)..(39): 2' Fluoro Guanosine
  modified_base (40)..(40): 2'O-Methyl Cytosine
  modified_base (41)..(41): 2' Fluoro Guanosine
  modified_base (42)..(42): 2'O-Methyl Cytosine
  modified_base (43)..(44): 2' Fluoro Guanosine
  modified_base (45)..(45): 2'O-Methyl Adenosine
  modified_base (46)..(47): 2' Fluoro Guanosine
  modified_base (48)..(48): 2'O-Methyl Cytosine
  modified_base (49)..(50): um
  modified_base (51)..(51): 2' Fluoro Guanosine
  modified_base (52)..(52): 2'O-Methyl Adenosine
  modified_base (53)..(54): 2' Fluoro Guanosine
  modified_base (55)..(55): um
  modified_base (56)..(56): 2'O-Methyl Adenosine
  modified_base (57)..(57): 2' Fluoro Guanosine
  modified_base (58)..(59): 2'O-Methyl Cytosine
  modified_base (60)..(60): 2' Fluoro Guanosine
  modified_base (61)..(63): um
  modified_base (64)..(64): gm
  modified_base (65)..(65): um
  modified_base (66)..(66): 2'O-Methyl Cytosine
  modified_base (67)..(68): gm
  modified_base (69)..(69): 2'O-Methyl Cytosine
  modified_base (69)..(69): inverted deoxythymidine incorporated at the 3'  end

SEQ ID NO: 240 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached  through the linker 1,3-propanediolspacer to 2'O-Methyl guanosine of SEQ ID NO: 357
gcggugggaaaugugagauggguugccgc

SEQ ID NO: 241 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker Hexaethylene glycol spacer to 2'O-Methyl guanosine of SEQ ID NO:358
gcggugggaaaugugagauggguugccgc

SEQ ID NO: 242 - RNA, 74 nt, Artificial Sequence; identical to SEQ ID NO: 232
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  modified_base (35)..(35): gm
  modified_base (36)..(37): 2'O-Methyl Cytosine
  modified_base (38)..(38): gm
  modified_base (39)..(39): 2'O-Methyl Adenosine
  modified_base (40)..(40): 2'O-Methyl Cytosine
  modified_base (41)..(41): um
  modified_base (42)..(43): 2'O-Methyl Cytosine
  modified_base (44)..(44): 2' Fluoro Guanosine
  modified_base (45)..(45): 2'O-Methyl Cytosine
  modified_base (46)..(46): 2' Fluoro Guanosine
  modified_base (47)..(47): 2'O-Methyl Cytosine
  modified_base (48)..(49): 2' Fluoro Guanosine
  modified_base (50)..(50): 2'O-Methyl Adenosine
  modified_base (51)..(52): 2' Fluoro Guanosine
  modified_base (53)..(53): 2'O-Methyl Cytosine
  modified_base (54)..(55): um
  modified_base (56)..(56): 2' Fluoro Guanosine
  modified_base (57)..(57): 2'O-Methyl Adenosine
  modified_base (58)..(59): 2' Fluoro Guanosine
  modified_base (60)..(60): um
  modified_base (61)..(61): 2'O-Methyl Adenosine
  modified_base (62)..(62): 2' Fluoro Guanosine
  modified_base (63)..(64): 2'O-Methyl Cytosine
  modified_base (65)..(65): 2' Fluoro Guanosine
  modified_base (66)..(68): um
  modified_base (69)..(69): gm
  modified_base (70)..(70): um
  modified_base (71)..(71): 2'O-Methyl Cytosine
  modified_base (72)..(73): gm
  modified_base (74)..(74): 2'O-Methyl Cytosine
  modified_base (74)..(74): inverted deoxythymidine incorporated at the 3'  end

SEQ ID NO: 243 - RNA, 79 nt, Artificial Sequence; identical to SEQ ID NO: 233
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(39): 2'O-Methyl deoxyuridine
  misc_feature (30)..(39): 2'O-Methyl deoxyuridine linker
  modified_base (40)..(40): gm
  modified_base (41)..(42): 2'O-Methyl Cytosine
  modified_base (43)..(43): gm
  modified_base (44)..(44): 2'O-Methyl Adenosine
  modified_base (46)..(46): um
  modified_base (47)..(48): 2'O-Methyl Cytosine
  modified_base (49)..(49): 2' Fluoro Guanosine
  modified_base (50)..(50): 2'O-Methyl Cytosine
  modified_base (51)..(51): 2' Fluoro Guanosine
  modified_base (52)..(52): 2'O-Methyl Cytosine
  modified_base (53)..(54): 2' Fluoro Guanosine
  modified_base (55)..(55): 2'O-Methyl Adenosine
  modified_base (56)..(57): 2' Fluoro Guanosine
  modified_base (58)..(58): 2'O-Methyl Cytosine
  modified_base (59)..(60): um
  modified_base (61)..(61): 2' Fluoro Guanosine
  modified_base (62)..(62): 2'O-Methyl Adenosine
  modified_base (63)..(64): 2' Fluoro Guanosine
  modified_base (65)..(65): um
  modified_base (66)..(66): 2'O-Methyl Adenosine
  modified_base (67)..(67): 2' Fluoro Guanosine
  modified_base (68)..(69): 2'O-Methyl Cytosine
  modified_base (70)..(70): 2' Fluoro Guanosine
  modified_base (71)..(73): um
  modified_base (74)..(74): gm
  modified_base (75)..(75): um
  modified_base (76)..(76): 2'O-Methyl Cytosine
  modified_base (77)..(78): gm
  modified_base (79)..(79): 2'O-Methyl Cytosine
  modified_base (79)..(79): inverted deoxythymidine incorporated at the 3'  end

SEQ ID NO: 244 - RNA, 73 nt, Artificial Sequence
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(36): um
  modified_base (35)..(35): gm
  modified_base (37)..(37): 2'O-Methyl Cytosine
  modified_base (38)..(39): gm
  modified_base (40)..(40): 2'O-Methyl Cytosine
  modified_base (41)..(41): gm
  modified_base (42)..(42): 2'O-Methyl Cytosine
  modified_base (43)..(43): gm
  modified_base (44)..(44): 2'O-Methyl Cytosine
  modified_base (45)..(46): gm
  modified_base (47)..(47): um
  modified_base (48)..(50): 2' Fluoro Guanosine
  modified_base (51)..(53): 2'O-Methyl Adenosine
  modified_base (54)..(54): um
  modified_base (55)..(55): 2' Fluoro Guanosine
  modified_base (56)..(56): um
  modified_base (57)..(57): 2' Fluoro Guanosine
  modified_base (58)..(58): 2'O-Methyl Adenosine
  modified_base (59)..(59): 2' Fluoro Guanosine
  modified_base (60)..(60): 2'O-Methyl Adenosine
  modified_base (61)..(61): um
  modified_base (62)..(64): 2' Fluoro Guanosine
  modified_base (65)..(66): um
  modified_base (67)..(67): gm
  modified_base (68)..(69): 2'O-Methyl Cytosine
  modified_base (70)..(70): gm
  modified_base (71)..(71): 2'O-Methyl Cytosine
  modified_base (72)..(72): gm
  modified_base (73)..(73): 2'O-Methyl Cytosine
  modified_base (73)..(73): inverted deoxythymidine incorporated at the 3'  end
gccgacuccgcgcggaggcuugagguagccguuugucggcgcgcggugggaaaugugagauggguugccgcgc

SEQ ID NO: 245 - RNA, 40 nt, Artificial Sequence; identical to SEQ ID NO: 110
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  misc_feature (40)..(40): The 2'O-Methyl cytosine is attached through the linker 1,3-propanediolspacer to 2'O-Methyl Guanosine of SEQ ID NO:359

SEQ ID NO: 246 - RNA, 40 nt, Artificial Sequence; identical to SEQ ID NO: 110
  aptamer
  modified_base (1)..(1): gm
  modified_base (2)..(3): 2'O-Methyl Adenosine
  modified_base (4)..(4): gm
  modified_base (5)..(5): 2'O-Methyl Adenosine
  modified_base (6)..(6): 2'O-Methyl Adenosine
  modified_base (7)..(7): um
  modified_base (8)..(9): 2'O-Methyl Adenosine
  modified_base (10)..(10): 2' Fluoro Guanosine
  modified_base (11)..(11): 2'O-Methyl Adenosine
  modified_base (12)..(12): 2' Fluoro Guanosine
  modified_base (13)..(13): 2'O-Methyl Adenosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Adenosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Adenosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Adenosine
  modified_base (38)..(39): gm
  modified_base (40)..(40): 2'O-Methyl Adenosine
  misc_feature (40)..(40): The 2'O-Methyl cytosine is attached through the linker hexaethylene glycol spacer to  2'O-Methyl Guanosine of SEQ ID:360

SEQ ID NO: 247 - RNA, 78 nt, Artificial Sequence
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(45): 2'O-Methyl deoxyuridine
  misc_feature (41)..(45): 2'O-Methyl deoxyuridine linker
  modified_base (46)..(46): gm
  modified_base (47)..(47): 2'O-Methyl Cytosine
  modified_base (48)..(48): gm
  modified_base (49)..(49): 2'O-Methyl Cytosine
  modified_base (51)..(51): gm
  modified_base (52)..(52): um
  modified_base (53)..(54): gm
  modified_base (53)..(55): 2' Fluoro Guanosine
  modified_base (56)..(58): 2'O-Methyl Adenosine
  modified_base (59)..(59): um
  modified_base (60)..(60): 2' Fluoro Guanosine
  modified_base (61)..(61): um
  modified_base (62)..(62): 2' Fluoro Guanosine
  modified_base (63)..(63): 2'O-Methyl Adenosine
  modified_base (64)..(64): 2' Fluoro Guanosine
  modified_base (65)..(65): 2'O-Methyl Adenosine
  modified_base (66)..(66): um
  modified_base (67)..(69): 2' Fluoro Guanosine
  modified_base (70)..(71): um
  modified_base (72)..(72): gm
  modified_base (73)..(74): 2'O-Methyl Cytosine
  modified_base (75)..(75): gm
  modified_base (76)..(76): 2'O-Methyl Cytosine
  modified_base (77)..(77): gm
  modified_base (78)..(78): 2'O-Methyl Cytosine
  modified_base (78)..(78): inverted deoxythymidine incorporated at the 3'  end
gccgacuccgcgcggaggcuugagguagccguuugucggcuuuuugcgcggugggaaaugugagauggguugccgcgc

SEQ ID NO: 248 - RNA, 83 nt, Artificial Sequence
  aptamer
  modified_base (1)..(1): gm
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (41)..(50): 2'O-Methyl deoxyuridine
  misc_feature (41)..(50): 2'O-Methyl deoxyuridine linker
  modified_base (51)..(51): gm
  modified_base (52)..(52): 2'O-Methyl Cytosine
  modified_base (53)..(53): gm
  modified_base (54)..(54): 2'O-Methyl Cytosine
  modified_base (55)..(56): gm
  modified_base (57)..(57): um
  modified_base (58)..(60): 2' Fluoro Guanosine
  modified_base (61)..(63): 2'O-Methyl Adenosine
  modified_base (64)..(64): um
  modified_base (65)..(65): 2' Fluoro Guanosine
  modified_base (66)..(66): um
  modified_base (67)..(67): 2' Fluoro Guanosine
  modified_base (68)..(68): 2'O-Methyl Adenosine
  modified_base (69)..(69): 2' Fluoro Guanosine
  modified_base (70)..(70): 2'O-Methyl Adenosine
  modified_base (71)..(71): um
  modified_base (72)..(74): 2' Fluoro Guanosine
  modified_base (75)..(76): um
  modified_base (77)..(77): gm
  modified_base (78)..(79): 2'O-Methyl Cytosine
  modified_base (80)..(80): gm
  modified_base (81)..(81): 2'O-Methyl Cytosine
  modified_base (82)..(82): gm
  modified_base (83)..(83): 2'O-Methyl Cytosine
  modified_base (83)..(83): inverted deoxythymidine incorporated at the 3'  end
gccgacuccgcgcggaggcuugagguagccguuugucggcuuuuuuuuuugcgcggugggaaaugugagauggguugccgcgc

SEQ ID NO: 249 - RNA, 73 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  modified_base (40)..(40): um
  modified_base (41)..(42): 2'O-Methyl Cytosine
  modified_base (43)..(43): 2' Fluoro Guanosine
  modified_base (44)..(44): 2'O-Methyl Cytosine
  modified_base (45)..(45): 2' Fluoro Guanosine
  modified_base (46)..(46): 2'O-Methyl Cytosine
  modified_base (47)..(48): 2' Fluoro Guanosine
  modified_base (49)..(49): 2'O-Methyl Adenosine
  modified_base (50)..(51): 2' Fluoro Guanosine
  modified_base (52)..(52): 2'O-Methyl Cytosine
  modified_base (53)..(54): um
  modified_base (55)..(55): 2' Fluoro Guanosine
  modified_base (56)..(56): 2'O-Methyl Adenosine
  modified_base (57)..(58): 2' Fluoro Guanosine
  modified_base (59)..(59): um
  modified_base (60)..(60): 2'O-Methyl Adenosine
  modified_base (61)..(61): 2' Fluoro Guanosine
  modified_base (62)..(63): 2'O-Methyl Cytosine
  modified_base (64)..(64): 2' Fluoro Guanosine
  modified_base (65)..(67): um
  modified_base (68)..(68): gm
  modified_base (69)..(69): um
  modified_base (70)..(70): 2'O-Methyl Cytosine
  modified_base (71)..(72): gm
  modified_base (73)..(73): 2'O-Methyl Cytosine
  modified_base (73)..(73): inverted deoxythymidine incorporated at the 3'  end
gcgcggugggaaaugugagauggguugccgcgcgccgacuccgcgcggaggcuugagguagccguuugucggc

SEQ ID NO: 250 - RNA, 73 nt, Artificial Sequence; identical to SEQ ID NO: 249
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  modified_base (40)..(40): um
  modified_base (41)..(42): 2'O-Methyl Cytosine
  modified_base (43)..(43): 2' Fluoro Guanosine
  modified_base (44)..(44): 2'O-Methyl Cytosine
  modified_base (45)..(45): 2' Fluoro Guanosine
  modified_base (46)..(46): 2'O-Methyl Cytosine
  modified_base (47)..(48): 2' Fluoro Guanosine
  modified_base (49)..(49): 2'O-Methyl Adenosine
  modified_base (50)..(51): 2' Fluoro Guanosine
  modified_base (52)..(52): 2'O-Methyl Cytosine
  modified_base (53)..(54): um
  modified_base (55)..(55): 2' Fluoro Guanosine
  modified_base (56)..(56): 2'O-Methyl Adenosine
  modified_base (57)..(58): 2' Fluoro Guanosine
  modified_base (59)..(59): um
  modified_base (60)..(60): 2'O-Methyl Adenosine
  modified_base (61)..(61): 2' Fluoro Guanosine
  modified_base (62)..(63): 2'O-Methyl Cytosine
  modified_base (64)..(64): 2' Fluoro Guanosine
  modified_base (65)..(67): um
  modified_base (68)..(68): gm
  modified_base (69)..(69): um
  modified_base (70)..(70): 2'O-Methyl Cytosine
  modified_base (71)..(72): gm
  modified_base (73)..(73): 2'O-Methyl Cytosine
  modified_base (73)..(73): inverted deoxythymidine incorporated at the 3'  end

SEQ ID NO: 251 - RNA, 73 nt, Artificial Sequence; identical to SEQ ID NO: 249
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2'O-Methyl Cytosine
  modified_base (11)..(13): 2'O-Methyl Adenosine
  modified_base (14)..(14): um
  modified_base (15)..(15): 2'O-Methyl Cytosine
  modified_base (16)..(16): um
  modified_base (17)..(17): 2'O-Methyl Cytosine
  modified_base (18)..(18): 2'O-Methyl Adenosine
  modified_base (19)..(19): 2'O-Methyl Cytosine
  modified_base (20)..(20): 2'O-Methyl Adenosine
  modified_base (21)..(21): um
  modified_base (22)..(24): 2'O-Methyl Cytosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  modified_base (40)..(40): um
  modified_base (41)..(42): 2'O-Methyl Cytosine
  modified_base (43)..(43): 2'O-Methyl Cytosine
  modified_base (44)..(44): 2'O-Methyl Cytosine
  modified_base (45)..(45): 2'O-Methyl Cytosine
  modified_base (46)..(46): 2'O-Methyl Cytosine
  modified_base (47)..(48): 2'O-Methyl Cytosine
  modified_base (49)..(49): 2'O-Methyl Adenosine
  modified_base (50)..(51): 2'O-Methyl Cytosine
  modified_base (52)..(52): 2'O-Methyl Cytosine
  modified_base (53)..(54): um
  modified_base (55)..(55): 2'O-Methyl Cytosine
  modified_base (56)..(56): 2'O-Methyl Adenosine
  modified_base (57)..(58): 2'O-Methyl Cytosine
  modified_base (59)..(59): um
  modified_base (60)..(60): 2'O-Methyl Adenosine
  modified_base (61)..(61): 2'O-Methyl Cytosine
  modified_base (62)..(63): 2'O-Methyl Cytosine
  modified_base (64)..(64): 2'O-Methyl Cytosine
  modified_base (65)..(67): um
  modified_base (68)..(68): gm
  modified_base (69)..(69): um
  modified_base (70)..(70): 2'O-Methyl Cytosine
  modified_base (71)..(72): gm
  modified_base (73)..(73): 2'O-Methyl Cytosine
  modified_base (73)..(73): inverted deoxythymidine incorporated at the 3'  end

SEQ ID NO: 252 - RNA, 78 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(39): gm
  modified_base (40)..(41): 2'O-Methyl Cytosine
  modified_base (42)..(42): 2' Fluoro Guanosine
  modified_base (43)..(43): 2'O-Methyl Adenosine
  modified_base (44)..(44): 2'O-Methyl Cytosine
  modified_base (45)..(45): um
  modified_base (46)..(47): 2'O-Methyl Cytosine
  modified_base (48)..(48): 2' Fluoro Guanosine
  modified_base (49)..(49): 2'O-Methyl Cytosine
  modified_base (50)..(50): 2' Fluoro Guanosine
  modified_base (51)..(51): 2'O-Methyl Cytosine
  modified_base (52)..(53): 2' Fluoro Guanosine
  modified_base (54)..(54): 2'O-Methyl Adenosine
  modified_base (55)..(56): 2' Fluoro Guanosine
  modified_base (57)..(57): 2'O-Methyl Cytosine
  modified_base (58)..(59): um
  modified_base (60)..(60): 2' Fluoro Guanosine
  modified_base (61)..(61): 2'O-Methyl Adenosine
  modified_base (62)..(63): 2' Fluoro Guanosine
  modified_base (64)..(64): um
  modified_base (65)..(65): 2'O-Methyl Adenosine
  modified_base (66)..(66): 2' Fluoro Guanosine
  modified_base (67)..(68): 2'O-Methyl Cytosine
  modified_base (69)..(69): 2' Fluoro Guanosine
  modified_base (70)..(72): um
  modified_base (73)..(73): gm
  modified_base (74)..(74): um
  modified_base (75)..(75): 2'O-Methyl Cytosine
  modified_base (76)..(77): gm
  modified_base (78)..(78): 2'O-Methyl Cytosine
  modified_base (78)..(78): inverted deoxythymidine incorporated at the 3'  end
gcgcggugggaaaugugagauggguugccgcgcuuuuugccgacuccgcgcggaggcuugagguagccguuugucggc

SEQ ID NO: 253 - RNA, 83 nt, Artificial Sequence
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): gm
  modified_base (45)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  modified_base (50)..(50): um
  modified_base (51)..(52): 2'O-Methyl Cytosine
  modified_base (53)..(53): 2' Fluoro Guanosine
  modified_base (54)..(54): 2'O-Methyl Cytosine
  modified_base (55)..(55): 2' Fluoro Guanosine
  modified_base (56)..(56): 2'O-Methyl Cytosine
  modified_base (57)..(58): 2' Fluoro Guanosine
  modified_base (59)..(59): 2'O-Methyl Adenosine
  modified_base (60)..(61): 2' Fluoro Guanosine
  modified_base (62)..(62): 2'O-Methyl Cytosine
  modified_base (63)..(64): um
  modified_base (65)..(65): 2' Fluoro Guanosine
  modified_base (66)..(66): 2'O-Methyl Adenosine
  modified_base (67)..(68): 2' Fluoro Guanosine
  modified_base (69)..(69): um
  modified_base (70)..(70): 2'O-Methyl Adenosine
  modified_base (71)..(71): 2' Fluoro Guanosine
  modified_base (72)..(73): 2'O-Methyl Cytosine
  modified_base (74)..(74): 2' Fluoro Guanosine
  modified_base (75)..(77): um
  modified_base (78)..(78): gm
  modified_base (79)..(79): um
  modified_base (80)..(80): 2'O-Methyl Cytosine
  modified_base (81)..(82): gm
  modified_base (83)..(83): 2'O-Methyl Cytosine
  modified_base (83)..(83): inverted deoxythymidine incorporated at the 3'  end
gcgcggugggaaaugugagauggguugccgcgcuuuuuuuuuugccgacuccgcgcggaggcuugagguagccguuugucggc

SEQ ID NO: 254 - RNA, 60 nt, Artificial Sequence
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(34): gm
  modified_base (36)..(36): um
  modified_base (37)..(39): 2' Fluoro Guanosine
  modified_base (37)..(38): gm
  modified_base (40)..(42): 2'O-Methyl Adenosine
  modified_base (43)..(43): um
  modified_base (44)..(44): 2' Fluoro Guanosine
  modified_base (45)..(45): um
  modified_base (46)..(46): 2' Fluoro Guanosine
  modified_base (47)..(47): 2'O-Methyl Adenosine
  modified_base (48)..(48): 2' Fluoro Guanosine
  modified_base (49)..(49): 2'O-Methyl Adenosine
  modified_base (50)..(50): um
  modified_base (51)..(53): 2' Fluoro Guanosine
  modified_base (54)..(55): um
  modified_base (57)..(58): 2'O-Methyl Cytosine
  modified_base (60)..(60): 2'O-Methyl Cytosine
  modified_base (60)..(60): inverted deoxythymidine incorporated at the 3'  end
ccgcgcggaggcuugagguagccguuugucggcggugggaaaugugagauggguugccgc

SEQ ID NO: 255 - RNA, 31 nt, Artificial Sequence; identical to SEQ ID NO: 20
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  misc_feature (31)..(31): The 2'O-Methyl Guanosine is attached through the linker 1,3-propanediol spacer to 2'O-Methyl Guanosine of SEQ ID NO:362

SEQ ID NO: 256 - RNA, 31 nt, Artificial Sequence; identical to SEQ ID NO: 20
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence CXAC
  modified_base (3)..(3): 2' Fluoro Guanosine
  modified_base (4)..(6): 2'O-Methyl Cytosine
  modified_base (5)..(5): 2' Fluoro Guanosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  misc_feature (31)..(31): The 2'O-Methyl Guanosine is attached through the linker Hexaethyleneglycol spacer to 2'O-Methyl Guanosine of SEQ ID NO:363

SEQ ID NO: 257 - RNA, 65 nt, Artificial Sequence
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(36): 2'O-Methyl deoxyuridine
  misc_feature (32)..(36): 2'O-Methyl deoxyuridine linker
  modified_base (37)..(37): gm
  modified_base (38)..(38): 2'O-Methyl Cytosine
  modified_base (39)..(39): gm
  modified_base (40)..(40): gm
  modified_base (41)..(41): um
  modified_base (42)..(44): 2' Fluoro Guanosine
  modified_base (45)..(47): 2'O-Methyl Adenosine
  modified_base (48)..(48): um
  modified_base (49)..(49): 2' Fluoro Guanosine
  modified_base (50)..(50): um
  modified_base (51)..(51): 2' Fluoro Guanosine
  modified_base (52)..(52): 2'O-Methyl Adenosine
  modified_base (53)..(53): 2' Fluoro Guanosine
  modified_base (54)..(54): 2'O-Methyl Adenosine
  modified_base (55)..(55): um
  modified_base (56)..(58): 2' Fluoro Guanosine
  modified_base (59)..(60): um
  modified_base (61)..(61): gm
  modified_base (62)..(63): 2'O-Methyl Cytosine
  modified_base (64)..(64): gm
  modified_base (65)..(65): 2'O-Methyl Cytosine
  modified_base (65)..(65): inverted deoxythymidine incorporated at the 3'  end
ccgcgcggaggcuugagguagccguuugucguuuuugcggugggaaaugugagauggguugccgc

SEQ ID NO: 258 - RNA, 70 nt, Artificial Sequence
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(41): 2'O-Methyl deoxyuridine
  misc_feature (32)..(41): 2'O-Methyl deoxyuridine linker
  modified_base (42)..(42): gm
  modified_base (43)..(43): 2'O-Methyl Cytosine
  modified_base (44)..(45): gm
  modified_base (46)..(46): um
  modified_base (47)..(49): 2' Fluoro Guanosine
  modified_base (50)..(52): 2'O-Methyl Adenosine
  modified_base (53)..(53): um
  modified_base (54)..(54): 2' Fluoro Guanosine
  modified_base (55)..(55): um
  modified_base (56)..(56): 2' Fluoro Guanosine
  modified_base (57)..(57): 2'O-Methyl Adenosine
  modified_base (58)..(58): 2' Fluoro Guanosine
  modified_base (59)..(59): 2'O-Methyl Adenosine
  modified_base (60)..(60): um
  modified_base (61)..(63): 2' Fluoro Guanosine
  modified_base (64)..(65): um
  modified_base (66)..(66): gm
  modified_base (67)..(68): 2'O-Methyl Cytosine
  modified_base (69)..(69): gm
  modified_base (70)..(70): 2'O-Methyl Cytosine
  modified_base (70)..(70): inverted deoxythymidine incorporated at the 3'  end
ccgcgcggaggcuugagguagccguuugucguuuuuuuuuugcggugggaaaugugagauggguugccgc

SEQ ID NO: 259 - RNA, 33 nt, Artificial Sequence; identical to SEQ ID NO: 178
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(30): 2'O-Methyl Cytosine
  modified_base (31)..(31): gm
  modified_base (32)..(32): 2'O-Methyl Adenosine
  modified_base (33)..(33): 2'O-Methyl Cytosine
  misc_feature (33)..(33): The 2'O-Methyl cytosine is attached through the linker 1,3-propanediol spacer to 2'O-Methyl cytosine of SEQ ID NO: 364

SEQ ID NO: 260 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker 1,3-propanediol spacer to 2'O-Methyl cytosine of another nucleotide sequence CXAC
gcggugggaaaugugagauggguugccgc

SEQ ID NO: 261 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker Hexaethyleneglycol spacer to 2'O-Methyl cytosine of another nucleotide sequence CXAC
gcggugggaaaugugagauggguugccgc

SEQ ID NO: 262 - RNA, 38 nt, Artificial Sequence; identical to SEQ ID NO: 181
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  modified_base (35)..(35): 2'O-Methyl Cytosine
  modified_base (36)..(36): gm
  modified_base (37)..(37): 2'O-Methyl Adenosine
  modified_base (38)..(38): 2'O-Methyl Cytosine
  misc_feature (38)..(38): The 2'O-Methyl cytosine is attached through the linker 1,3-propanediol spacer to 2'O-Methyl cytosine of SEQ ID NO:367

SEQ ID NO: 263 - RNA, 43 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(39): 2'O-Methyl deoxyuridine
  misc_feature (30)..(39): 2'O-Methyl deoxyuridine linker
  modified_base (40)..(40): 2'O-Methyl Cytosine
  modified_base (41)..(41): gm
  modified_base (42)..(42): 2'O-Methyl Adenosine
  modified_base (43)..(43): 2'O-Methyl Cytosine
  misc_feature (43)..(43): The 2'O-Methyl cytosine is attached through the linker 1,3-propanediol spacer to 2'O-Methyl cytosine of SEQ ID NO:368
gcggugggaaaugugagauggguugccgcuuuuuuuuuucgac

SEQ ID NO: 264 - RNA, 62 nt, Artificial Sequence
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(34): gm
  modified_base (35)..(35): 2'O-Methyl Cytosine
  modified_base (36)..(37): gm
  modified_base (38)..(38): um
  modified_base (39)..(41): 2' Fluoro Guanosine
  modified_base (42)..(44): 2'O-Methyl Adenosine
  modified_base (45)..(45): um
  modified_base (46)..(46): 2' Fluoro Guanosine
  modified_base (47)..(47): um
  modified_base (48)..(48): 2' Fluoro Guanosine
  modified_base (49)..(49): 2'O-Methyl Adenosine
  modified_base (50)..(50): 2' Fluoro Guanosine
  modified_base (51)..(51): 2'O-Methyl Adenosine
  modified_base (52)..(52): um
  modified_base (53)..(55): 2' Fluoro Guanosine
  modified_base (56)..(57): um
  modified_base (58)..(58): gm
  modified_base (59)..(60): 2'O-Methyl Cytosine
  modified_base (61)..(61): gm
  modified_base (62)..(62): 2'O-Methyl Cytosine
  modified_base (62)..(62): inverted deoxythymidine incorporated at the 3'  end
ccgcgcggaggcuugagguagccguuugucggcgcggugggaaaugugagauggguugccgc

SEQ ID NO: 265 - RNA, 33 nt, Artificial Sequence; identical to SEQ ID NO: 152
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(7): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  misc_feature (33)..(33): The 2'O-Methyl cytosine is attached through the linker 1,3-propanediol spacer to  2'O-Methyl Guanosine of SEQ ID NO:369

SEQ ID NO: 266 - RNA, 33 nt, Artificial Sequence; identical to SEQ ID NO: 152
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  misc_feature (33)..(33): The 2'O-Methyl cytosine is attached through the linker Hexaethyleneglycol spacer to 2'O-Methyl Guanosine of SEQ ID NO:370

SEQ ID NO: 267 - RNA, 67 nt, Artificial Sequence
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(39): gm
  modified_base (40)..(40): 2'O-Methyl Cytosine
  modified_base (41)..(42): gm
  modified_base (43)..(43): um
  modified_base (44)..(46): 2' Fluoro Guanosine
  modified_base (47)..(49): 2'O-Methyl Adenosine
  modified_base (50)..(50): um
  modified_base (51)..(51): 2' Fluoro Guanosine
  modified_base (52)..(52): um
  modified_base (53)..(53): 2' Fluoro Guanosine
  modified_base (54)..(54): 2'O-Methyl Adenosine
  modified_base (55)..(55): 2' Fluoro Guanosine
  modified_base (56)..(56): 2'O-Methyl Adenosine
  modified_base (57)..(57): um
  modified_base (58)..(60): 2' Fluoro Guanosine
  modified_base (61)..(62): um
  modified_base (63)..(63): gm
  modified_base (64)..(65): 2'O-Methyl Cytosine
  modified_base (66)..(66): gm
  modified_base (67)..(67): 2'O-Methyl Cytosine
  modified_base (67)..(67): inverted deoxythymidine incorporated at the 3'  end
ccgcgcggaggcuugagguagccguuugucggcuuuuugcggugggaaaugugagauggguugccgc

SEQ ID NO: 268 - RNA, 72 nt, Artificial Sequence
  aptamer
  modified_base (1)..(2): 2'O-Methyl Cytosine
  misc_feature (1)..(1): The 2'O-Methyl cytosine is attached through the linker 1,3-propanediol spacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): gm
  modified_base (45)..(45): 2'O-Methyl Cytosine
  modified_base (46)..(47): gm
  modified_base (48)..(48): um
  modified_base (49)..(51): 2' Fluoro Guanosine
  modified_base (52)..(54): 2'O-Methyl Adenosine
  modified_base (55)..(55): um
  modified_base (56)..(56): 2' Fluoro Guanosine
  modified_base (57)..(57): um
  modified_base (58)..(58): 2' Fluoro Guanosine
  modified_base (58)..(58): 2' Fluoro Guanosine
  modified_base (59)..(59): 2'O-Methyl Adenosine
  modified_base (60)..(60): 2' Fluoro Guanosine
  modified_base (61)..(61): 2'O-Methyl Adenosine
  modified_base (62)..(62): um
  modified_base (63)..(65): 2' Fluoro Guanosine
  modified_base (66)..(67): um
  modified_base (68)..(68): gm
  modified_base (69)..(70): 2'O-Methyl Cytosine
  modified_base (71)..(71): gm
  modified_base (72)..(72): 2'O-Methyl Cytosine
  modified_base (72)..(72): inverted deoxythymidine incorporated at the 3'  end
ccgcgcggaggcuugagguagccguuugucggcuuuuuuuuuugcggugggaaaugugagauggguugccgc

SEQ ID NO: 269 - RNA, 35 nt, Artificial Sequence; identical to SEQ ID NO: 188
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(30): gm
  modified_base (31)..(32): 2'O-Methyl Cytosine
  modified_base (33)..(33): gm
  modified_base (34)..(34): 2'O-Methyl Adenosine
  modified_base (35)..(35): 2'O-Methyl Cytosine
  misc_feature (35)..(35): The 2'O-Methyl cytosine is attached through the linker 1,3-propanediolspacer to 2'O-Methyl cytosine of SEQ ID NO:371

SEQ ID NO: 270 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker 1,3-propanediolspacer to 2'O-Methyl Guanosine of another nucleotide sequence XCCXAC
  misc_feature (29)..(29): The 2'O-Methyl cytosine is attached through the linker 1,3-propanediolspacer to 2'O-Methyl Guanosine of another nucleotide sequence XCCXAC
gcggugggaaaugugagauggguugccgc

SEQ ID NO: 271 - RNA, 29 nt, Artificial Sequence
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker Hexaethyleneglycol spacer to 2'O-Methyl Guanosine of another nucleotide sequence XCCXAC
gcggugggaaaugugagauggguugccgc

SEQ ID NO: 272 - RNA, 40 nt, Artificial Sequence; identical to SEQ ID NO: 191
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(34): 2'O-Methyl deoxyuridine
  misc_feature (30)..(34): 2'O-Methyl deoxyuridine linker
  modified_base (35)..(35): gm
  modified_base (36)..(37): 2'O-Methyl Cytosine
  modified_base (38)..(38): gm
  modified_base (39)..(39): 2'O-Methyl Adenosine
  modified_base (40)..(40): 2'O-Methyl Cytosine
  misc_feature (40)..(40): The 2'O-Methyl cytosine is attached through the linker 1,3-propanediolspacer to 2'O-Methyl cytosine of SEQ ID NO:374

SEQ ID NO: 273 - RNA, 45 nt, Artificial Sequence; identical to SEQ ID NO: 192
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (30)..(39): 2'O-Methyl deoxyuridine
  misc_feature (30)..(39): 2'O-Methyl deoxyuridine linker
  modified_base (40)..(40): gm
  modified_base (41)..(42): 2'O-Methyl Cytosine
  modified_base (43)..(43): gm
  modified_base (44)..(44): 2'O-Methyl Adenosine
  modified_base (45)..(45): 2'O-Methyl Cytosine
  misc_feature (45)..(45): The 2'O-Methyl cytosine is attached through the linker 1,3-propanediolspacer to 2'O-Methyl cytosine of SEQ ID NO:375

SEQ ID NO: 274 - RNA, 64 nt, Artificial Sequence
  aptamer
  misc_feature (1)..(1): The 2'O-Methyl cytosine is attached through the linker 1,3-propanediolspacer to 2'O-Methyl cytosine of another nucleotide sequence CXAC
  modified_base (1)..(2): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): um
  modified_base (29)..(29): um
  modified_base (30)..(30): 2'O-Methyl Cytosine
  modified_base (31)..(32): um
  modified_base (33)..(33): 2'O-Methyl Cytosine
  modified_base (34)..(34): um
  modified_base (35)..(35): 2'O-Methyl Cytosine
  modified_base (36)..(37): um
  modified_base (38)..(38): um
  modified_base (39)..(41): 2' Fluoro Guanosine
  modified_base (42)..(44): 2'O-Methyl Adenosine
  modified_base (45)..(45): um
  modified_base (46)..(46): 2' Fluoro Guanosine
  modified_base (47)..(47): um
  modified_base (48)..(48): 2' Fluoro Guanosine
  modified_base (49)..(49): 2'O-Methyl Adenosine
  modified_base (50)..(50): 2' Fluoro Guanosine
  modified_base (51)..(51): 2'O-Methyl Adenosine
  modified_base (52)..(52): um
  modified_base (53)..(55): 2' Fluoro Guanosine
  modified_base (56)..(57): um
  modified_base (58)..(58): um
  modified_base (59)..(60): 2'O-Methyl Cytosine
  modified_base (61)..(61): um
  modified_base (62)..(62): 2'O-Methyl Cytosine
  modified_base (63)..(63): um
  modified_base (64)..(64): inverted deoxythymidine incorporated at the 3'  end
  modified_base (64)..(64): 2'O-Methyl Cytosine
ccgcgcggaggcuugagguagccguuugucggcgcggugggaaaugugagauggguugccgcgc

SEQ ID NO: 275 - RNA, 31 nt, Artificial Sequence; identical to SEQ ID NO: 20
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  misc_feature (31)..(31): The 2'O-Methyl Guanosine is attached through the linker 1,3-propanediolspacer to 2'O-Methyl Guanosine of SEQ ID NO:376

SEQ ID NO: 276 - RNA, 31 nt, Artificial Sequence; identical to SEQ ID NO: 20
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): gm
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): gm
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): gm
  modified_base (28)..(28): gm
  modified_base (29)..(29): gm
  modified_base (30)..(30): 2'O-Methyl Cytosine
  modified_base (31)..(31): gm
  misc_feature (31)..(31): The 2'O-Methyl Guanosine is attached through the linker hexaethylene glycol spacer to 2'O-Methyl Guanosine of SEQ ID:377

SEQ ID NO: 277 - RNA, 69 nt, Artificial Sequence
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(36): 2'O-Methyl deoxyuridine
  misc_feature (32)..(36): 2'O-Methyl deoxyuridine linker
  modified_base (37)..(37): gm
  modified_base (38)..(38): 2'O-Methyl Cytosine
  modified_base (39)..(39): gm
  modified_base (40)..(40): 2'O-Methyl Cytosine
  modified_base (41)..(42): gm
  modified_base (43)..(43): um
  modified_base (44)..(46): 2' Fluoro Guanosine
  modified_base (47)..(49): 2'O-Methyl Adenosine
  modified_base (50)..(50): um
  modified_base (51)..(51): 2' Fluoro Guanosine
  modified_base (52)..(52): um
  modified_base (53)..(53): 2' Fluoro Guanosine
  modified_base (54)..(54): 2'O-Methyl Adenosine
  modified_base (55)..(55): 2' Fluoro Guanosine
  modified_base (56)..(56): 2'O-Methyl Adenosine
  modified_base (57)..(57): um
  modified_base (58)..(60): 2' Fluoro Guanosine
  modified_base (61)..(62): um
  modified_base (63)..(63): gm
  modified_base (64)..(65): 2'O-Methyl Cytosine
  modified_base (66)..(66): gm
  modified_base (67)..(67): 2'O-Methyl Cytosine
  modified_base (68)..(68): gm
  modified_base (69)..(69): 2'O-Methyl Cytosine
  modified_base (69)..(69): inverted deoxythymidine incorporated at the 3'  end
ccgcgcggaggcuugagguagccguuugucguuuuugcgcggugggaaaugugagauggguugccgcgc

SEQ ID NO: 278 - RNA, 74 nt, Artificial Sequence
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (32)..(41): 2'O-Methyl deoxyuridine
  misc_feature (32)..(41): 2'O-Methyl deoxyuridine linker
  modified_base (42)..(42): gm
  modified_base (43)..(43): 2'O-Methyl Cytosine
  modified_base (44)..(44): gm
  modified_base (45)..(45): 2'O-Methyl Cytosine
  modified_base (46)..(47): gm
  modified_base (48)..(48): um
  modified_base (49)..(51): 2' Fluoro Guanosine
  modified_base (52)..(54): 2'O-Methyl Adenosine
  modified_base (55)..(55): um
  modified_base (56)..(56): 2' Fluoro Guanosine
  modified_base (57)..(57): um
  modified_base (58)..(58): 2' Fluoro Guanosine
  modified_base (59)..(59): 2'O-Methyl Adenosine
  modified_base (60)..(60): 2' Fluoro Guanosine
  modified_base (61)..(61): 2'O-Methyl Adenosine
  modified_base (62)..(62): um
  modified_base (63)..(65): 2' Fluoro Guanosine
  modified_base (66)..(67): um
  modified_base (68)..(68): gm
  modified_base (69)..(70): 2'O-Methyl Cytosine
  modified_base (71)..(71): gm
  modified_base (72)..(72): 2'O-Methyl Cytosine
  modified_base (73)..(73): gm
  modified_base (74)..(74): 2'O-Methyl Cytosine
  modified_base (74)..(74): inverted deoxythymidine incorporated at the 3'  end
ccgcgcggaggcuugagguagccguuugucguuuuuuuuuugcgcggugggaaaugugagauggguugccgcgc

SEQ ID NO: 279 - RNA, 33 nt, Artificial Sequence; identical to SEQ ID NO: 178
  aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(30): 2'O-Methyl Cytosine
  modified_base (31)..(31): gm
  modified_base (32)..(32): 2'O-Methyl Adenosine
  modified_base (33)..(33): 2'O-Methyl Cytosine
  misc_feature (33)..(33): The 2'O-Methyl cytosine is attached through the linker 1,3-propanediolspacer to 2'O-Methyl cytosine of SEQ ID NO:378

SEQ ID NO: 280 - RNA, 33 nt, Artificial Sequence; identical to SEQ ID NO: 193
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  misc_feature (33)..(33): The 2'O-Methyl cytosine is attached through the linker 1,3-propanediolspacer to 2'O-Methyl cytosine of another nucleotide sequence CXAC

SEQ ID NO: 281 - RNA, 33 nt, Artificial Sequence; identical to SEQ ID NO: 193
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  misc_feature (33)..(33): The 2'O-Methyl cytosine is attached through the linker Hexaethyleneglycol spacer to 2'O-Methyl cytosine of another nucleotide sequence CXAC

SEQ ID NO: 282 - RNA, 47 nt, Artificial Sequence; identical to SEQ ID NO: 160
  aptamer
  modified_base (1)..(2): gm
  modified_base (3)..(3): 2'O-Methyl Cytosine
  modified_base (4)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (14)..(14): 2'O-Methyl Adenosine
  modified_base (15)..(16): um
  modified_base (17)..(17): 2'O-Methyl Adenosine
  modified_base (18)..(18): um
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (39)..(43): 2'O-Methyl deoxyuridine
  misc_feature (39)..(43): 2'O-Methyl deoxyuridine linker
  modified_base (44)..(44): 2'O-Methyl Cytosine
  modified_base (45)..(45): gm
  modified_base (46)..(46): 2'O-Methyl Adenosine
  modified_base (47)..(47): 2'O-Methyl Cytosine
  misc_feature (47)..(47): The 2'O-Methyl cytosine is attached through the linker 1,3-propanediolspacer to 2'O-Methyl cytosine of SEQ ID NO:381

SEQ ID NO: 283 - RNA, 47 nt, Artificial Sequence; identical to SEQ ID NO: 203
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): 2'O-Methyl Cytosine
  modified_base (45)..(45): gm
  modified_base (46)..(46): 2'O-Methyl Adenosine
  modified_base (47)..(47): 2'O-Methyl Cytosine
  misc_feature (47)..(47): The 2'O-Methyl cytosine is attached through the linker 1,3-propanediolspacer to 2'O-Methyl cytosine of SEQ ID NO:382

SEQ ID NO: 284 - RNA, 66 nt, Artificial Sequence
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(34): gm
  modified_base (35)..(35): 2'O-Methyl Cytosine
  modified_base (36)..(36): gm
  modified_base (37)..(37): 2'O-Methyl Cytosine
  modified_base (38)..(39): gm
  modified_base (40)..(40): um
  modified_base (41)..(43): 2' Fluoro Guanosine
  modified_base (44)..(46): 2'O-Methyl Adenosine
  modified_base (47)..(47): um
  modified_base (48)..(48): 2' Fluoro Guanosine
  modified_base (49)..(49): um
  modified_base (50)..(50): 2' Fluoro Guanosine
  modified_base (51)..(51): 2'O-Methyl Adenosine
  modified_base (52)..(52): 2' Fluoro Guanosine
  modified_base (53)..(53): 2'O-Methyl Adenosine
  modified_base (54)..(54): um
  modified_base (55)..(57): 2' Fluoro Guanosine
  modified_base (58)..(59): um
  modified_base (60)..(60): gm
  modified_base (61)..(62): 2'O-Methyl Cytosine
  modified_base (63)..(63): gm
  modified_base (64)..(64): 2'O-Methyl Cytosine
  modified_base (65)..(65): gm
  modified_base (66)..(66): 2'O-Methyl Cytosine
  modified_base (66)..(66): inverted deoxythymidine incorporated at the 3'  end
ccgcgcggaggcuugagguagccguuugucggcgcgcggugggaaaugugagauggguugccgcgc

SEQ ID NO: 285 - RNA, 33 nt, Artificial Sequence; identical to SEQ ID NO: 152
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  misc_feature (33)..(33): The 2'O-Methyl cytosine is attached through the linker 1,3-propanediolspacer to 2'O-Methyl Guanosine of SEQ ID NO:383

SEQ ID NO: 286 - RNA, 33 nt, Artificial Sequence; identical to SEQ ID NO: 152
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (18)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  misc_feature (33)..(33): The 2'O-Methyl cytosine is attached through the linker hexaethylene glycol spacer to 2'O-Methyl Guanosine of SEQ ID:384

SEQ ID NO: 287 - RNA, 71 nt, Artificial Sequence
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (12)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(39): gm
  modified_base (40)..(40): 2'O-Methyl Cytosine
  modified_base (41)..(41): gm
  modified_base (42)..(42): 2'O-Methyl Cytosine
  modified_base (43)..(44): gm
  modified_base (45)..(45): um
  modified_base (46)..(48): 2' Fluoro Guanosine
  modified_base (49)..(51): 2'O-Methyl Adenosine
  modified_base (52)..(52): um
  modified_base (53)..(53): 2' Fluoro Guanosine
  modified_base (54)..(54): um
  modified_base (55)..(55): 2' Fluoro Guanosine
  modified_base (56)..(56): 2'O-Methyl Adenosine
  modified_base (57)..(57): 2' Fluoro Guanosine
  modified_base (58)..(58): 2'O-Methyl Adenosine
  modified_base (59)..(59): um
  modified_base (60)..(62): 2' Fluoro Guanosine
  modified_base (63)..(64): um
  modified_base (66)..(67): 2'O-Methyl Cytosine
  modified_base (69)..(69): 2'O-Methyl Cytosine
  modified_base (71)..(71): 2'O-Methyl Cytosine
  modified_base (71)..(71): inverted deoxythymidine incorporated at the 3'  end
ccgcgcggaggcuugagguagccguuugucggcuuuuugcgcggugggaaaugugagauggguugccgcgc

SEQ ID NO: 288 - RNA, 76 nt, Artificial Sequence
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): gm
  modified_base (45)..(45): 2'O-Methyl Cytosine
  modified_base (46)..(46): gm
  modified_base (47)..(47): 2'O-Methyl Cytosine
  modified_base (48)..(49): gm
  modified_base (50)..(50): um
  modified_base (51)..(53): 2' Fluoro Guanosine
  modified_base (54)..(56): 2'O-Methyl Adenosine
  modified_base (57)..(57): um
  modified_base (58)..(58): 2' Fluoro Guanosine
  modified_base (59)..(59): um
  modified_base (60)..(60): 2' Fluoro Guanosine
  modified_base (61)..(61): 2'O-Methyl Adenosine
  modified_base (62)..(62): 2' Fluoro Guanosine
  modified_base (63)..(63): 2'O-Methyl Adenosine
  modified_base (64)..(64): um
  modified_base (65)..(67): 2' Fluoro Guanosine
  modified_base (68)..(69): um
  modified_base (70)..(70): gm
  modified_base (71)..(72): 2'O-Methyl Cytosine
  modified_base (73)..(73): gm
  modified_base (74)..(74): 2'O-Methyl Cytosine
  modified_base (75)..(75): gm
  modified_base (76)..(76): 2'O-Methyl Cytosine
  modified_base (76)..(76): inverted deoxythymidine incorporated at the 3'  end
ccgcgcggaggcuugagguagccguuugucggcuuuuuuuuuugcgcggugggaaaugugagauggguugccgcgc

SEQ ID NO: 289 - RNA, 39 nt, Artificial Sequence; identical to SEQ ID NO: 209
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  misc_feature (39)..(39): The 2'O-Methyl cytosine is attached through the linker 1,3-propanediolspacer to 2'O-Methyl cytosine of SEQ ID NO:385

SEQ ID NO: 290 - RNA, 39 nt, Artificial Sequence; identical to SEQ ID NO: 209
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  misc_feature (39)..(39): The 2'O-Methyl cytosine is attached through the linker 1,3-propanediolspacer to 2'O-Methyl cytosine of SEQ ID NO:386

SEQ ID NO: 291 - RNA, 39 nt, Artificial Sequence; identical to SEQ ID NO: 209
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  misc_feature (39)..(39): The 2'O-Methyl cytosine is attached through the linker 1,3-propanediolspacer to 2'O-Methyl cytosine of SEQ ID NO:387

SEQ ID NO: 292 - RNA, 44 nt, Artificial Sequence; identical to SEQ ID NO: 212
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(39): gm
  modified_base (40)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  misc_feature (44)..(44): The 2'O-Methyl cytosine is attached through the linker 1,3-propanediolspacer to 2'O-Methyl cytosine of SEQ ID NO:388

SEQ ID NO: 293 - RNA, 49 nt, Artificial Sequence; identical to SEQ ID NO: 213
  aptamer
  modified_base (1)..(1): gm
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(44): gm
  modified_base (45)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  misc_feature (49)..(49): The 2'O-Methyl cytosine is attached through the linker 1,3-propanediolspacer to 2'O-Methyl cytosine of SEQ ID NO:389

SEQ ID NO: 294 - protein, 206 aa, Artificial Sequence
  aptamer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 295 - protein, 189 aa, Artificial Sequence
  aptamer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 296 - protein, 165 aa, Artificial Sequence
  aptamer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 297 - protein, 121 aa, Artificial Sequence
  aptamer
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 298 - protein, 110 aa, Artificial Sequence
  human VEGF-A110
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDR

SEQ ID NO: 299 - protein, 77 aa, Artificial Sequence
  human IL878
AVLPRSAKELRCQCIKTYSKPFHPKFIKELRVIESGPHCANTEIIVKLSDGRELCLDPKENWVQRVVEKFLKRAENS

SEQ ID NO: 300 - protein, 72 aa, Artificial Sequence
  human IL872
SAKELRCQCIKTYSKPFHPKFIKELRVIESGPHCANTEIIVKLSDGRELCLDPKENWVQRVVEKFLKRAENS

SEQ ID NO: 301 - protein, 478 aa, Artificial Sequence
  human Ang2
YNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 302 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:73
  misc_feature (1)..(1): The 2'O-Methyl cytosine is attached through the linker 1,3-propanediolspacer to 2'O-Methyl cytosine of another nucleotide sequence XCCXAC
  misc_feature (1)..(1): The 2'O-Methyl cytosine is attached through the linker 1,3-propanediolspacer to 2'O-Methyl cytosine of SEQ ID NO:76
  misc_feature (1)..(1): The 2'O-Methyl cytosine is attached through the linker 1,3-propanediolspacer to 2'O-Methyl cytosine of SEQ ID NO:77
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): inverted deoxythymidine incorporated at the 3'  end
  modified_base (33)..(33): 2'O-Methyl Cytosine

SEQ ID NO: 303 - RNA, 38 nt, Artificial Sequence; identical to SEQ ID NO: 78
  Aptamer
  modified_base (1)..(1): gm
  misc_feature (1)..(1): The  2'O-Methyl Guanosine is attached through the linker 1,3-propanediolspacer to 2'O-Methyl Guanosine of SEQ ID NO:153
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 304 - RNA, 38 nt, Artificial Sequence; identical to SEQ ID NO: 78
  Aptamer
  modified_base (1)..(1): gm
  misc_feature (1)..(1): The 2'O-Methyl Guanosine is attached through the linker hexaethylene glycol spacer to 2'O-Methyl Guanosine of SEQ ID:154
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 305 - RNA, 31 nt, Artificial Sequence; identical to SEQ ID NO: 20
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:157
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): innverted deoxythymidine incorporated at the 3'  end

SEQ ID NO: 306 - RNA, 31 nt, Artificial Sequence; identical to SEQ ID NO: 20
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (27)..(27): um
  modified_base (28)..(28): gm
  modified_base (29)..(29): um
  modified_base (30)..(30): 2'O-Methyl Cytosine
  modified_base (31)..(31): inverted deoxythymidine incorporated at the 3'  end
  modified_base (31)..(31): gm

SEQ ID NO: 307 - RNA, 31 nt, Artificial Sequence; identical to SEQ ID NO: 20
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 308 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediolspacer to 2'O-Methyl cytosine of SEQ ID NO:160
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 309 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediolspacer to 2'O-Methyl cytosine of SEQ ID NO:161
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 310 - RNA, 38 nt, Artificial Sequence; identical to SEQ ID NO: 78
  Aptamer
  misc_feature (1)..(1): The 2'O-Methyl Guanosine is attached through the linker 1,3-propanediolspacer to 2'O-Methyl cytosine of SEQ ID NO:163
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 311 - RNA, 38 nt, Artificial Sequence; identical to SEQ ID NO: 78
  Aptamer
  modified_base (1)..(1): gm
  modified_base (1)..(1): The 2'O-Methyl Guanosine is attached through the linker hexaethylene glycol spacer to 2'O-Methyl cytosine of SEQ ID:164
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(19): 2' Fluoro Guanosine
  modified_base (20)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 312 - RNA, 38 nt, Artificial Sequence; identical to SEQ ID NO: 78
  Aptamer
  misc_feature (1)..(1): 2'O-Methyl guanosine is attached to 2'O-Methyl deoxyuridine linker of SEQ ID NO: 165
  misc_feature (1)..(1): 2'O-Methyl guanosine is attached to 2'O-Methyl deoxyuridine linker of SEQ ID NO: 165
  modified_base (1)..(1): gm
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): inverted deoxythymidine incorporated at the 3'  end
  modified_base (38)..(38): 2'O-Methyl Cytosine

SEQ ID NO: 313 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:167
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 314 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:168
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 315 - RNA, 33 nt, Artificial Sequence; identical to SEQ ID NO: 152
  Aptamer
  modified_base (1)..(2): 2'O-Methyl Cytosine
  modified_base (1)..(1): The 2'O-Methyl cytosine is attached through the linker 1,3-propanediolspacer to 2'O-Methyl cytosine of SEQ ID NO:169
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 316 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:170
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 317 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:171
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 318 - RNA, 29 nt, Artificial Sequence
  Aptamer
  misc_feature (1)..(1): The 2'O-Methyl Guanosine  is attached through the linker 1,3-propanediolspacer to  2'O-Methyl Guanosine of SEQ ID NO:174
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 319 - RNA, 29 nt, Artificial Sequence
  Aptamer
  modified_base (1)..(1): gm
  misc_feature (1)..(1): The 2'O-Methyl Guanosine is attached through the linker hexaethylene glycol spacer to 2'O-Methyl Guanosine of SEQ ID:175
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 320 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:178
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 321 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): inverted deoxythymidine incorporated at the 3'  end
  modified_base (33)..(33): gm

SEQ ID NO: 322 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 323 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:181
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 324 - RNA, 33 nt, Artificial Sequence; identical to SEQ ID NO: 1
  The 2'O-Methyl cytosine is attached through the linker 1,3-propanediolspacer to 2'O-Methyl cytosine of SEQ ID NO:181
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 325 - RNA, 29 nt, Artificial Sequence
  Aptamer
  misc_feature (1)..(1): The 2'O-Methyl Guanosine  is attached through the linker 1,3-propanediolspacer to 2'O-Methyl cytosine of SEQ ID NO:184
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 326 - RNA, 29 nt, Artificial Sequence
  Aptamer
  modified_base (1)..(1): gm
  misc_feature (1)..(1): The 2'O-Methyl Guanosine  is attached through the linker hexaethylene glycol spacer to 2'O-Methyl cytosine of SEQ ID:185
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 327 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:188
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(28): um
  modified_base (29)..(29): gm
  modified_base (30)..(30): 2' Fluoro Guanosine
  modified_base (31)..(31): um
  modified_base (32)..(32): 2'O-Methyl Cytosine
  modified_base (33)..(34): gm
  modified_base (35)..(35): 2'O-Methyl Adenosine
  modified_base (35)..(35): 2'O-Methyl Cytosine

SEQ ID NO: 328 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(28): um
  modified_base (29)..(29): gm
  modified_base (30)..(30): 2' Fluoro Guanosine
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 329 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(28): um
  modified_base (29)..(29): gm
  modified_base (30)..(30): 2' Fluoro Guanosine
  modified_base (31)..(31): um
  modified_base (32)..(32): 2'O-Methyl Cytosine
  modified_base (33)..(34): gm
  modified_base (35)..(35): inverted deoxythymidine incorporated at the 3'  end
  modified_base (35)..(35): 2'O-Methyl Cytosine

SEQ ID NO: 330 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:191
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(28): um
  modified_base (29)..(29): gm
  modified_base (30)..(30): 2' Fluoro Guanosine
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 331 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:192
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(28): um
  modified_base (29)..(29): gm
  modified_base (30)..(30): 2' Fluoro Guanosine
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 332 - RNA, 33 nt, Artificial Sequence; identical to SEQ ID NO: 193
  Aptamer
  modified_base (1)..(1): gm
  misc_feature (1)..(1): The 2'O-Methyl Guanosine is attached through the linker 1,3-propanediolspacer to 2'O-Methyl Guanosine of SEQ ID NO:195
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 333 - RNA, 33 nt, Artificial Sequence; identical to SEQ ID NO: 193
  Aptamer
  modified_base (1)..(1): gm
  misc_feature (1)..(1): The 2'O-Methyl Guanosine is attached through the linker hexaethylene glycol spacer to 2'O-Methyl Guanosine  of SEQ ID:196
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 334 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:199
  misc_feature (1)..(1): The 2'O-Methyl cytosine is attached through the linker 1,3-propanediolspacer to 2'O-Methyl cytosine of SEQ ID NO:199
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 335 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 336 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 337 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID:202
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 338 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:203
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 339 - RNA, 33 nt, Artificial Sequence; identical to SEQ ID NO: 193
  Aptamer
  modified_base (1)..(1): gm
  misc_feature (1)..(1): The 2'O-Methyl Guanosine is attached through the linker 1,3-propanediolspacer to 2'O-Methyl cytosine of SEQ ID NO:205
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 340 - RNA, 33 nt, Artificial Sequence; identical to SEQ ID NO: 193
  Aptamer
  modified_base (1)..(1): gm
  misc_feature (1)..(1): The 2'O-Methyl Guanosine is attached through the linker hexaethylene glycol spacer to 2'O-Methyl cytosine of SEQ ID:206
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 341 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:209
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 342 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 343 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 344 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:212
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 345 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:213
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): inverted deoxythymidine incorporated at the 3'  end
  modified_base (35)..(35): 2'O-Methyl Cytosine

SEQ ID NO: 346 - RNA, 29 nt, Artificial Sequence
  Aptamer
  modified_base (1)..(1): gm
  misc_feature (1)..(1): The 2'O-Methyl Guanosine is attached through the linker 1,3-propanediolspacer to 2'O-Methyl Guanosine of SEQ ID NO:215
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 347 - RNA, 29 nt, Artificial Sequence
  Aptamer
  modified_base (1)..(1): gm
  misc_feature (1)..(1): The  2'O-Methyl Guanosine is attached through the linker hexaethylene glycol spacer to  2'O-Methyl Guanosine of SEQ ID:216
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 348 - RNA, 36 nt, Artificial Sequence; identical to SEQ ID NO: 9
  Aptamer
  modified_base (1)..(1): 2'O-Methyl Cytosine
  misc_feature (1)..(1): The 2'O-Methyl cytosine is attached through the linker 1,3-propanediolspacer to 2'O-Methyl cytosine of SEQ ID NO:220
  modified_base (2)..(2): 2'O-Methyl Adenosine
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): 2'O-Methyl Adenosine
  modified_base (34)..(34): um
  modified_base (35)..(35): 2'O-Methyl Cytosine
  modified_base (36)..(36): 2'O-Methyl Adenosine

SEQ ID NO: 349 - RNA, 29 nt, Artificial Sequence
  Aptamer
  modified_base (1)..(1): gm
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  misc_feature (29)..(29): The 2'O-Methyl cytosine is attached through the linker hexaethylene glycol spacer to 2'O-Methyl cytosine of SEQ ID:350
gcggugggaaaugugagauggguugccgc

SEQ ID NO: 350 - RNA, 36 nt, Artificial Sequence; identical to SEQ ID NO: 9
  Aptamer
  modified_base (1)..(1): 2'O-Methyl Cytosine
  misc_feature (1)..(1): The 2'O-Methyl cytosine is attached through the linker hexaethylene glycol spacer to 2'O-Methyl cytosine of SEQ ID NO:349
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  modified_base (36)..(36): inverted deoxythymidine incorporated at the 3'  end

SEQ ID NO: 351 - RNA, 29 nt, Artificial Sequence
  Aptamer
  modified_base (1)..(1): gm
  misc_feature (1)..(1): The 2'O-Methyl Guanosine is attached through the linker 1,3-propanediolspacer to 2'O-Methyl cytosine of SEQ ID NO:225
  misc_feature (1)..(1): The 2'O-Methyl Guanosine is attached through the linker 1,3-propanediolspacer to 2'O-Methyl cytosine of SEQ ID NO:225
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 352 - RNA, 29 nt, Artificial Sequence
  Aptamer
  modified_base (1)..(1): gm
  misc_feature (1)..(1): The 2'O-Methyl Guanosine is attached through the linker hexaethylene glycol spacer to 2'O-Methyl cytosine of SEQ ID:226
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 353 - RNA, 40 nt, Artificial Sequence; identical to SEQ ID NO: 110
  Aptamer
  modified_base (1)..(1): gm
  misc_feature (1)..(1): The 2'O-Methyl Guanosine is attached through the linker 1,3-propanediolspacer to 2'O-Methyl cytosine of SEQ ID NO:230
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (40)..(40): inverted deoxythymidine incorporated at the 3'  end

SEQ ID NO: 354 - RNA, 40 nt, Artificial Sequence; identical to SEQ ID NO: 110
  Aptamer
  modified_base (1)..(1): gm
  misc_feature (1)..(1): The 2'O-Methyl Guanosine is attached through the linker hexaethylene glycol spacer to 2'O-Methyl cytosine of SEQ ID:231
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (40)..(40): inverted deoxythymidine incorporated at the 3'  end

SEQ ID NO: 355 - RNA, 33 nt, Artificial Sequence; identical to SEQ ID NO: 193
  Aptamer
  modified_base (1)..(1): gm
  misc_feature (1)..(1): The 2'O-Methyl Guanosine is attached through the linker 1,3-propanediolspacer to2'O-Methyl Guanosine of SEQ ID NO:235
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (8)..(10): 2' Fluoro Guanosine
  modified_base (11)..(13): 2'O-Methyl Adenosine
  modified_base (15)..(15): 2' Fluoro Guanosine
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (22)..(24): 2' Fluoro Guanosine
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 356 - RNA, 33 nt, Artificial Sequence; identical to SEQ ID NO: 193
  aptamer
  modified_base (1)..(1): gm
  misc_feature (1)..(1): The 2'O-Methyl Guanosine is attached through the linker hexaethylene glycol spacer to  2'O-Methyl Guanosine of SEQ ID NO:236
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 357 - RNA, 40 nt, Artificial Sequence; identical to SEQ ID NO: 110
  aptamer
  modified_base (1)..(1): gm
  misc_feature (1)..(1): The 2'O-Methyl Guanosine is attached through the linker 1,3-propanediolspacer to 2'O-Methyl cytosine of SEQ ID NO:240
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (40)..(40): inverted deoxythymidine incorporated at the 3'  end

SEQ ID NO: 358 - RNA, 40 nt, Artificial Sequence; identical to SEQ ID NO: 110
  aptamer
  modified_base (1)..(1): gm
  misc_feature (1)..(1): The 2'O-Methyl Guanosine is attached through the linker hexaethylene glycol spacer to 2'O-Methyl cytosine of SEQ ID:241
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (40)..(40): inverted deoxythymidine incorporated at the 3'  end

SEQ ID NO: 359 - RNA, 33 nt, Artificial Sequence; identical to SEQ ID NO: 193
  aptamer
  modified_base (1)..(1): gm
  misc_feature (1)..(1): The 2'O-Methyl guanosine is attached through the linker 1,3-propanediolspacer to 2'O-Methyl cytosine of SEQ ID NO: 245
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 360 - RNA, 33 nt, Artificial Sequence; identical to SEQ ID NO: 193
  Aptamer
  modified_base (1)..(1): gm
  misc_feature (1)..(1): The 2'O-Methyl guanosine is attached through the linker hexaethylene glycol spacer to 2'O-Methyl cytosine  of SEQ ID NO: 246
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 361 - skipped

SEQ ID NO: 362 - RNA, 29 nt, Artificial Sequence
  Aptamer
  modified_base (1)..(1): gm
  misc_feature (1)..(1): The 2'O-Methyl Guanosine is  is attached through the linker 1,3-propanediol spacer to 2'O-Methyl Guanosine of SEQ ID NO:255
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 363 - RNA, 29 nt, Artificial Sequence
  Aptamer
  modified_base (1)..(1): gm
  misc_feature (1)..(1): The 2'O-Methyl Guanosine is attached through the linker Hexaethyleneglycol spacer to 2'O-Methyl Guanosine SEQ ID NO:256
  misc_feature (1)..(1): The 2'O-Methyl Guanosine is attached through the linker Hexaethyleneglycol spacer to 2'O-Methyl Guanosine SEQ ID NO:256
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 364 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediol spacer to 2'O-Methyl cytosine of SEQ ID NO:259
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 365 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediol spacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 366 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediol spacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 367 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediol spacer to 2'O-Methyl cytosine of SEQ ID NO:262
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 368 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediol spacer to 2'O-Methyl cytosine of SEQ ID NO:263
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 369 - RNA, 29 nt, Artificial Sequence
  Aptamer
  modified_base (1)..(1): gm
  misc_feature (1)..(1): The 2'O-Methyl Guanosine is attached through the linker 1,3-propanediol spacer to 2'O-Methyl cytosine of SEQ ID NO:265
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 370 - RNA, 29 nt, Artificial Sequence
  Aptamer
  modified_base (1)..(1): gm
  misc_feature (1)..(1): The 2'O-Methyl Guanosine is attached through the linker hexaethylene glycol spacer to 2'O-Methyl cytosine of SEQ ID:266
  modified_base (2)..(2): 2'O-Methyl Cytosine
  modified_base (3)..(4): gm
  modified_base (5)..(5): um
  modified_base (6)..(8): 2' Fluoro Guanosine
  modified_base (9)..(11): 2'O-Methyl Adenosine
  modified_base (12)..(12): um
  modified_base (13)..(13): 2' Fluoro Guanosine
  modified_base (14)..(14): um
  modified_base (15)..(15): 2' Fluoro Guanosine
  modified_base (16)..(16): 2'O-Methyl Adenosine
  modified_base (17)..(17): 2' Fluoro Guanosine
  modified_base (18)..(18): 2'O-Methyl Adenosine
  modified_base (19)..(19): um
  modified_base (20)..(22): 2' Fluoro Guanosine
  modified_base (23)..(24): um
  modified_base (25)..(25): gm
  modified_base (26)..(27): 2'O-Methyl Cytosine
  modified_base (28)..(28): gm
  modified_base (29)..(29): 2'O-Methyl Cytosine
  modified_base (29)..(29): inverted deoxythymidine incorporated at the 3'  end
gcggugggaaaugugagauggguugccgc

SEQ ID NO: 371 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:269
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 372 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 373 - RNA, 33 nt, Artificial Sequence; identical to SEQ ID NO: 152
  Aptamer
  modified_base (1)..(2): 2'O-Methyl Cytosine
  modified_base (1)..(1): The 2'O-Methyl cytosine is attached through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 374 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:272
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 375 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO:273
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 376 - RNA, 33 nt, Artificial Sequence; identical to SEQ ID NO: 193
  Aptamer
  modified_base (1)..(1): gm
  misc_feature (1)..(1): The 2'O-Methyl Guanosine is attached through the linker 1,3-propanediolspacer to 2'O-Methyl Guanosine of SEQ ID NO:275
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): inverted deoxythymidine incorporated at the 3'  end

SEQ ID NO: 377 - RNA, 33 nt, Artificial Sequence; identical to SEQ ID NO: 193
  Aptamer
  modified_base (1)..(1): gm
  misc_feature (1)..(1): The 2'O-Methyl guanosine is attached through the linker 1,3-propanediolspacer to 2'O-Methyl  guanosine of SEQ ID NO: 276
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 378 - RNA, 31 nt, Artificial Sequence; identical to SEQ ID NO: 20
  Aptamer
  modified_base (1)..(1): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end
  misc_feature (31)..(31): The 2'O-Methyl cytosine is attached through the linker 1,3-propanediolspacer to 2'O-Methyl  cytosine of SEQ ID NO: 279

SEQ ID NO: 379 - RNA, 31 nt, Artificial Sequence; identical to SEQ ID NO: 20
  Aptamer
  modified_base (1)..(1): 2'O-Methyl Cytosine
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end
  misc_feature (31)..(31): The 2'O-Methyl cytosine is attached through the linker 1,3-propanediolspacer to 2'O-Methyl  cytosine of SEQ ID NO: 280

SEQ ID NO: 380 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediolspacer to 2'O-Methyl  cytosine of SEQ ID NO: 281
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 381 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached through the linker 1,3-propanediolspacer to 2'O-Methyl  cytosine of SEQ ID NO: 282
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 382 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine  is attached through the linker 1,3-propanediolspacer to 2'O-Methyl  cytosine  of SEQ ID NO:283
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): inverted deoxythymidine incorporated at the 3'  end
  modified_base (31)..(31): gm

SEQ ID NO: 383 - RNA, 33 nt, Artificial Sequence; identical to SEQ ID NO: 193
  aptamer
  modified_base (1)..(1): gm
  misc_feature (1)..(1): The 2'O-Methyl guanosine is attached through the linker 1,3-propanediolspacer to 2'O-Methyl  cytosine  of SEQ ID NO: 285
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): inverted deoxythymidine incorporated at the 3'  end
  modified_base (33)..(33): 2'O-Methyl Cytosine

SEQ ID NO: 384 - RNA, 33 nt, Artificial Sequence; identical to SEQ ID NO: 193
  aptamer
  modified_base (1)..(1): gm
  misc_feature (1)..(1): The 2'O-Methyl guanosine is attached through the linker 1,3-propanediolspacer to 2'O-Methyl  cytosine  of SEQ ID NO: 286
  modified_base (2)..(2): 2'O-Methyl Cytosine
  modified_base (3)..(3): gm
  modified_base (4)..(4): 2'O-Methyl Cytosine
  modified_base (5)..(6): gm
  modified_base (7)..(7): um
  modified_base (8)..(10): 2' Fluoro Guanosine
  modified_base (11)..(13): 2'O-Methyl Adenosine
  modified_base (14)..(14): um
  modified_base (15)..(15): 2' Fluoro Guanosine
  modified_base (16)..(16): um
  modified_base (17)..(17): 2' Fluoro Guanosine
  modified_base (18)..(18): 2'O-Methyl Adenosine
  modified_base (19)..(19): 2' Fluoro Guanosine
  modified_base (20)..(20): 2'O-Methyl Adenosine
  modified_base (21)..(21): um
  modified_base (22)..(24): 2' Fluoro Guanosine
  modified_base (25)..(26): um
  modified_base (27)..(27): gm
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(33): 2'O-Methyl Cytosine
  modified_base (33)..(33): inverted deoxythymidine incorporated at the 3'  end

SEQ ID NO: 385 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 289
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 386 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 290
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 387 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 291
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 388 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 292
  misc_feature (1)..(1): The 2'O-Methyl cytosine is attached through the linker 1,3-propanediolspacer to 2'O-Methyl cytosine of SEQ ID NO: 292
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): inverted deoxythymidine incorporated at the 3'  end
  modified_base (33)..(33): 2'O-Methyl Cytosine

SEQ ID NO: 389 - RNA, 33 nt, Artificial Sequence; identical to SEQ ID NO: 152
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 293
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (33)..(33): inverted deoxythymidine incorporated at the 3'  end

SEQ ID NO: 390 - skipped

SEQ ID NO: 391 - RNA, 34 nt, Artificial Sequence; identical to SEQ ID NO: 48
  aptamer
  modified_base (1)..(2): gm
  misc_feature (1)..(1): The 2'O-Methyl guanosine is attached  through the linker 1,3-propanediolspacer to 2'O-Methyl guanosine of SEQ ID NO: 58
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (10)..(10): 2'O-Methyl Adenosine
  modified_base (11)..(11): gm
  modified_base (12)..(12): 2'O-Methyl Adenosine
  modified_base (15)..(15): 2'O-Methyl Adenosine
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (24)..(24): 2' Fluoro Guanosine
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 392 - RNA, 34 nt, Artificial Sequence; identical to SEQ ID NO: 48
  aptamer
  modified_base (1)..(2): gm
  misc_feature (1)..(1): The 2'O-Methyl guanosine is attached through the linker Hexaethylene glycol spacer to 2'O-Methyl guanosine of SEQ ID NO:59
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 393 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): inverted deoxythymidine incorporated at the 3'  end
  modified_base (33)..(33): gm

SEQ ID NO: 394 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 395 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 396 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of SEQ ID NO: 65
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): inverted deoxythymidine incorporated at the 3'  end
  modified_base (33)..(33): gm

SEQ ID NO: 397 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 398 - RNA, 34 nt, Artificial Sequence; identical to SEQ ID NO: 48
  aptamer
  modified_base (1)..(2): gm
  misc_feature (1)..(1): The 2'O-Methyl guanosine is attached through the linker 1,3-propanediolspacer to 2'O-Methyl cytosine of SEQ ID NO: 69
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 399 - RNA, 34 nt, Artificial Sequence; identical to SEQ ID NO: 48
  aptamer
  modified_base (1)..(2): gm
  misc_feature (1)..(1): The 2'O-Methyl guanosine is attached through the linker hexaethylene glycol spacer to 2'O-Methyl cytosine of SEQ ID NO: 70
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 400 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 73
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 401 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 74
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 402 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 75
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 403 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 76
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 404 - RNA, 35 nt, Artificial Sequence; identical to SEQ ID NO: 67
  aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 77
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 405 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker 1,3-propanediolspacer to 2'O-Methyl guanosine of SEQ ID NO: 80
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 406 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker hexaethylene glycol spacer to 2'O-Methyl guanosine of SEQ ID NO: 81
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 407 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 84
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 408 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 85
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 409 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 86
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 410 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 86
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 411 - RNA, 33 nt, Artificial Sequence; identical to SEQ ID NO: 1
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 88
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(33): gm
  modified_base (33)..(33): inverted deoxythymidine incorporated at the 3'  end

SEQ ID NO: 412 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker 1,3-propanediolspacer to 2'O-Methyl cytosine of SEQ ID NO: 90
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 413 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker hexaethylene glycol spacer to 2'O-Methyl cytosine of SEQ ID NO: 91
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): ininverted deoxythymidine incorporated at the 3'  end

SEQ ID NO: 414 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 94
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 415 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 95
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 416 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 96
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 417 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 97
  misc_feature (1)..(1): The 2'O-Methyl cytosine is attached through the linker 1,3-propanediolspacer to 2'O-Methyl cytosine of SEQ ID NO: 97
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 418 - RNA, 35 nt, Artificial Sequence; identical to SEQ ID NO: 67
  Aptamer
  modified_base (1)..(2): 2'O-Methyl Cytosine
  misc_feature (1)..(1): The 2'O-Methyl cytosine is attached through the linker 1,3-propanediolspacer to 2'O-Methyl cytosine of SEQ ID NO: 98
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(12): 2' Fluoro Guanosine
  modified_base (13)..(13): gm
  modified_base (14)..(16): um
  modified_base (17)..(17): 2'O-Methyl Cytosine
  modified_base (18)..(18): 2'O-Methyl Adenosine
  modified_base (19)..(19): um
  modified_base (20)..(21): 2'O-Methyl Adenosine
  modified_base (22)..(22): um
  modified_base (23)..(25): 2'O-Methyl Cytosine
  modified_base (26)..(26): 2' Fluoro Guanosine
  modified_base (27)..(29): um
  modified_base (30)..(30): gm
  modified_base (31)..(31): um
  modified_base (32)..(32): 2'O-Methyl Cytosine
  modified_base (33)..(34): gm
  modified_base (35)..(35): 2'O-Methyl Cytosine
  modified_base (35)..(35): inverted deoxythymidine incorporated at the 3'  end

SEQ ID NO: 419 - RNA, 34 nt, Artificial Sequence; identical to SEQ ID NO: 48
  Aptamer
  modified_base (1)..(2): gm
  misc_feature (1)..(1): The 2'O-Methyl guanosine is attached through the linker 1,3-propanediolspacer to 2'O-Methyl guanosine of SEQ ID NO: 101
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 420 - RNA, 34 nt, Artificial Sequence; identical to SEQ ID NO: 48
  Aptamer
  modified_base (1)..(2): gm
  misc_feature (1)..(1): The 2'O-Methyl guanosine is attached through the linker hexaethylene glycol spacer to 2'O-Methyl guanosine of SEQ ID NO: 102
  misc_feature (1)..(1): The 2'O-Methyl guanosine is attached through the linker hexaethylene glycol spacer to 2'O-Methyl guanosine of SEQ ID NO: 102
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 421 - RNA, 36 nt, Artificial Sequence; identical to SEQ ID NO: 9
  Aptamer
  modified_base (1)..(1): 2'O-Methyl Cytosine
  misc_feature (1)..(1): The 2'O-Methyl cytosine is attached through the linker 1,3-propanediolspacer to 2'O-Methyl cytosine of SEQ ID NO: 106
  modified_base (2)..(2): gm
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm

SEQ ID NO: 422 - RNA, 36 nt, Artificial Sequence; identical to SEQ ID NO: 9
  Aptamer
  modified_base (1)..(1): 2'O-Methyl Cytosine
  misc_feature (1)..(1): The 2'O-Methyl cytosine is attached through the linker hexaethylene glycol spacer to 2'O-Methyl cytosine of SEQ ID NO: 106
  modified_base (3)..(3): 2'O-Methyl Adenosine
  modified_base (4)..(4): 2'O-Methyl Cytosine
  modified_base (5)..(5): um
  modified_base (6)..(7): 2'O-Methyl Cytosine
  modified_base (8)..(8): 2' Fluoro Guanosine
  modified_base (9)..(9): 2'O-Methyl Cytosine
  modified_base (10)..(10): 2' Fluoro Guanosine
  modified_base (11)..(11): 2'O-Methyl Cytosine
  modified_base (12)..(13): 2' Fluoro Guanosine
  modified_base (13)..(13): gm
  modified_base (14)..(14): 2'O-Methyl Adenosine
  modified_base (15)..(16): 2' Fluoro Guanosine
  modified_base (17)..(17): 2'O-Methyl Cytosine
  modified_base (18)..(19): um
  modified_base (20)..(20): 2' Fluoro Guanosine
  modified_base (21)..(21): 2'O-Methyl Adenosine
  modified_base (22)..(23): 2' Fluoro Guanosine
  modified_base (24)..(24): um
  modified_base (25)..(25): 2'O-Methyl Adenosine
  modified_base (26)..(26): 2' Fluoro Guanosine
  modified_base (27)..(28): 2'O-Methyl Cytosine
  modified_base (29)..(29): 2' Fluoro Guanosine
  modified_base (30)..(32): um
  modified_base (33)..(33): gm
  modified_base (34)..(34): um
  modified_base (35)..(35): 2'O-Methyl Cytosine
  modified_base (36)..(36): gm
  modified_base (36)..(36): inverted deoxythymidine incorporated at the 3'  end

SEQ ID NO: 423 - RNA, 34 nt, Artificial Sequence; identical to SEQ ID NO: 48
  Aptamer
  modified_base (1)..(2): gm
  misc_feature (1)..(1): The 2'O-Methyl guanosine is attached through the linker 1,3-propanediolspacer to 2'O-Methyl cytosine of SEQ ID NO: 112
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 424 - RNA, 34 nt, Artificial Sequence; identical to SEQ ID NO: 48
  Aptamer
  modified_base (1)..(2): gm
  misc_feature (1)..(1): The 2'O-Methyl guanosine is attached through the linker hexaethylene glycol spacer to 2'O-Methyl cytosine of SEQ ID NO: 113
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 425 - RNA, 40 nt, Artificial Sequence; identical to SEQ ID NO: 110
  Aptamer
  modified_base (1)..(1): gm
  misc_feature (1)..(1): The 2'O-Methyl guanosine is attached through the linker 1,3-propanediolspacer to 2'O-Methyl cytosine of SEQ ID NO: 117
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): inverted deoxythymidine incorporated at the 3'  end
  modified_base (40)..(40): 2'O-Methyl Cytosine

SEQ ID NO: 426 - RNA, 40 nt, Artificial Sequence; identical to SEQ ID NO: 110
  Aptamer
  modified_base (1)..(1): I
  misc_feature (1)..(1): The 2'O-Methyl guanosine is attached through the linker hexaethylene glycol spacer to 2'O-Methyl cytosine of SEQ ID NO: 118
  modified_base (2)..(3): 2'O-Methyl Cytosine
  modified_base (4)..(4): I
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): I
  modified_base (36)..(36): um
  modified_base (37)..(37): 2'O-Methyl Cytosine
  modified_base (38)..(39): I
  modified_base (40)..(40): inverted deoxythymidine incorporated at the 3'  end
  modified_base (40)..(40): 2'O-Methyl Cytosine

SEQ ID NO: 427 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker 1,3-propanediolspacer to 2'O-Methyl guanosine of SEQ ID NO: 122
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 428 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker hexaethylene glycol spacer to 2'O-Methyl guanosine of SEQ ID NO: 123
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): inverted deoxythymidine incorporated at the 3'  end
  modified_base (38)..(38): 2'O-Methyl Cytosine

SEQ ID NO: 429 - RNA, 40 nt, Artificial Sequence; identical to SEQ ID NO: 110
  aptamer
  modified_base (1)..(1): gm
  misc_feature (1)..(1): The 2'O-Methyl guanosine is attached through the linker 1,3-propanediolspacer to 2'O-Methyl cytosine of SEQ ID NO: 127
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (40)..(40): inverted deoxythymidine incorporated at the 3'  end

SEQ ID NO: 430 - RNA, 40 nt, Artificial Sequence; identical to SEQ ID NO: 110
  aptamer
  modified_base (1)..(1): gm
  misc_feature (1)..(1): The 2'O-Methyl guanosine is attached through the linker Hexaethylene glycol spacer to 2'O-Methyl cytosine of SEQ ID NO:128
  modified_base (2)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(7): um
  modified_base (8)..(9): 2'O-Methyl Cytosine
  modified_base (10)..(10): 2' Fluoro Guanosine
  modified_base (11)..(11): 2'O-Methyl Cytosine
  modified_base (12)..(12): 2' Fluoro Guanosine
  modified_base (13)..(13): 2'O-Methyl Cytosine
  modified_base (14)..(15): 2' Fluoro Guanosine
  modified_base (16)..(16): 2'O-Methyl Adenosine
  modified_base (17)..(18): 2' Fluoro Guanosine
  modified_base (19)..(19): 2'O-Methyl Cytosine
  modified_base (20)..(21): um
  modified_base (22)..(22): 2' Fluoro Guanosine
  modified_base (23)..(23): 2'O-Methyl Adenosine
  modified_base (24)..(25): 2' Fluoro Guanosine
  modified_base (26)..(26): um
  modified_base (27)..(27): 2'O-Methyl Adenosine
  modified_base (28)..(28): 2' Fluoro Guanosine
  modified_base (29)..(30): 2'O-Methyl Cytosine
  modified_base (31)..(31): 2' Fluoro Guanosine
  modified_base (32)..(34): um
  modified_base (35)..(35): gm
  modified_base (36)..(36): um
  modified_base (37)..(37): 2'O-Methyl Cytosine
  modified_base (38)..(39): gm
  modified_base (40)..(40): 2'O-Methyl Cytosine
  modified_base (40)..(40): inverted deoxythymidine incorporated at the 3'  end

SEQ ID NO: 431 - RNA, 38 nt, Artificial Sequence; identical to SEQ ID NO: 78
  Aptamer
  modified_base (1)..(1): gm
  misc_feature (1)..(1): The 2'O-Methyl guanosine is attached  through the linker 1,3-propanediolspacer to 2'O-Methyl cytosine of SEQ ID NO: 132
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 432 - RNA, 38 nt, Artificial Sequence; identical to SEQ ID NO: 78
  Aptamer
  modified_base (1)..(1): gm
  misc_feature (1)..(1): The 2'O-Methyl guanosine is attached through the linker Hexaethylene glycol spacer to 2'O-Methyl cytosine of SEQ ID NO:133
  modified_base (2)..(2): 2'O-Methyl Cytosine
  modified_base (3)..(4): gm
  modified_base (5)..(5): 2'O-Methyl Cytosine
  modified_base (6)..(6): gm
  modified_base (7)..(7): 2'O-Methyl Adenosine
  modified_base (8)..(8): 2'O-Methyl Cytosine
  modified_base (9)..(10): gm
  modified_base (11)..(11): um
  modified_base (12)..(12): 2'O-Methyl Adenosine
  modified_base (13)..(13): gm
  modified_base (14)..(14): 2'O-Methyl Adenosine
  modified_base (15)..(16): um
  modified_base (17)..(17): 2'O-Methyl Adenosine
  modified_base (18)..(18): um
  modified_base (19)..(21): 2' Fluoro Guanosine
  modified_base (22)..(22): 2'O-Methyl Cytosine
  modified_base (23)..(23): 2'O-Methyl Adenosine
  modified_base (24)..(24): 2' Fluoro Guanosine
  modified_base (25)..(25): um
  modified_base (26)..(26): 2' Fluoro Guanosine
  modified_base (27)..(27): um
  modified_base (28)..(28): 2' Fluoro Guanosine
  modified_base (29)..(29): 2'O-Methyl Adenosine
  modified_base (30)..(31): 2'O-Methyl Cytosine
  modified_base (32)..(32): gm
  modified_base (33)..(33): 2'O-Methyl Cytosine
  modified_base (34)..(34): gm
  modified_base (35)..(36): 2'O-Methyl Cytosine
  modified_base (37)..(37): gm
  modified_base (38)..(38): 2'O-Methyl Cytosine
  modified_base (38)..(38): inverted deoxythymidine incorporated at the 3'  end

SEQ ID NO: 433 - RNA, 34 nt, Artificial Sequence; identical to SEQ ID NO: 48
  aptamer
  modified_base (1)..(2): gm
  misc_feature (1)..(1): The 2'O-Methyl guanosine is attached  through the linker 1,3-propanediolspacer to 2'O-Methyl guanosine of SEQ ID NO: 143
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 434 - RNA, 34 nt, Artificial Sequence; identical to SEQ ID NO: 48
  aptamer
  modified_base (1)..(2): gm
  misc_feature (1)..(1): The 2'O-Methyl guanosine is attached through the linker Hexaethylene glycol spacer to 2'O-Methyl guanosine of SEQ ID NO:144
  modified_base (3)..(3): 2'O-Methyl Cytosine
  modified_base (4)..(4): gm
  modified_base (5)..(5): 2'O-Methyl Adenosine
  modified_base (6)..(6): 2'O-Methyl Cytosine
  modified_base (7)..(8): gm
  modified_base (9)..(9): um
  modified_base (10)..(10): 2'O-Methyl Adenosine
  modified_base (11)..(11): gm
  modified_base (12)..(12): 2'O-Methyl Adenosine
  modified_base (13)..(14): um
  modified_base (15)..(15): 2'O-Methyl Adenosine
  modified_base (16)..(16): um
  modified_base (17)..(19): 2' Fluoro Guanosine
  modified_base (20)..(20): 2'O-Methyl Cytosine
  modified_base (21)..(21): 2'O-Methyl Adenosine
  modified_base (22)..(22): 2' Fluoro Guanosine
  modified_base (23)..(23): um
  modified_base (24)..(24): 2' Fluoro Guanosine
  modified_base (25)..(25): um
  modified_base (26)..(26): 2' Fluoro Guanosine
  modified_base (27)..(27): 2'O-Methyl Adenosine
  modified_base (28)..(29): 2'O-Methyl Cytosine
  modified_base (30)..(30): gm
  modified_base (31)..(31): 2'O-Methyl Cytosine
  modified_base (32)..(32): gm
  modified_base (33)..(34): 2'O-Methyl Cytosine
  modified_base (34)..(34): inverted deoxythymidine incorporated at the 3'  end

SEQ ID NO: 435 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached  through the linker 1,3-propanediolspacer to 2'O-Methyl cytosine of SEQ ID NO: 147
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 436 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 437 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached  through the linker 1,3-propanediolspacer to 2'O-Methyl cytosine of another nucleotide sequence CXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 438 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached  through the linker 1,3-propanediolspacer to 2'O-Methyl cytosine of SEQ ID NO: 150
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 439 - RNA, 67 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (1)..(2): gm
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (6)..(6): 2'O-Methyl Cytosine
  modified_base (9)..(9): 2'O-Methyl Adenosine
  modified_base (12)..(12): 2'O-Methyl Cytosine
  modified_base (16)..(16): 2'O-Methyl Adenosine
  modified_base (20)..(20): 2'O-Methyl Adenosine
  modified_base (22)..(23): 2'O-Methyl Cytosine
  modified_base (27)..(27): um
  modified_base (28)..(28): gm
  modified_base (30)..(30): 2'O-Methyl Cytosine
  modified_base (30)..(30): 2'O-Methyl Cytosine
  modified_base (31)..(32): gm
  modified_base (32)..(32): 2' Fluoro Guanosine
  modified_base (33)..(33): 2'O-Methyl Cytosine
  modified_base (34)..(35): gm
  modified_base (36)..(36): 2'O-Methyl Cytosine
  modified_base (37)..(37): gm
  modified_base (38)..(38): 2'O-Methyl Adenosine
  modified_base (39)..(39): 2'O-Methyl Cytosine
  modified_base (40)..(41): gm
  modified_base (43)..(43): 2'O-Methyl Adenosine
  modified_base (44)..(44): gm
  modified_base (45)..(45): 2'O-Methyl Adenosine
  modified_base (48)..(48): 2'O-Methyl Adenosine
  modified_base (53)..(53): 2'O-Methyl Cytosine
  modified_base (54)..(54): 2'O-Methyl Adenosine
  modified_base (60)..(60): 2'O-Methyl Adenosine
  modified_base (60)..(60): gm
  modified_base (61)..(62): 2'O-Methyl Cytosine
  modified_base (63)..(63): gm
  modified_base (64)..(64): 2'O-Methyl Cytosine
  modified_base (66)..(67): 2'O-Methyl Cytosine
  modified_base (67)..(67): inverted deoxythymidine incorporated at the 3'  end
ccgcgcggaggcuugagguagccguuugucggcggcgacgguagauuaugggcagugugaccgcgcc

SEQ ID NO: 440 - RNA, 72 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(38): 2'O-Methyl deoxyuridine
  misc_feature (34)..(38): 2'O-Methyl deoxyuridine linker
  modified_base (39)..(40): gm
  modified_base (41)..(41): 2'O-Methyl Cytosine
  modified_base (42)..(42): gm
  modified_base (43)..(43): 2'O-Methyl Adenosine
  modified_base (44)..(44): 2'O-Methyl Cytosine
  modified_base (45)..(46): gm
  modified_base (47)..(47): um
  modified_base (48)..(48): 2'O-Methyl Adenosine
  modified_base (49)..(49): gm
  modified_base (50)..(50): 2'O-Methyl Adenosine
  modified_base (51)..(52): um
  modified_base (53)..(53): 2'O-Methyl Adenosine
  modified_base (54)..(54): um
  modified_base (55)..(57): 2' Fluoro Guanosine
  modified_base (58)..(58): 2'O-Methyl Cytosine
  modified_base (59)..(59): 2'O-Methyl Adenosine
  modified_base (60)..(60): 2' Fluoro Guanosine
  modified_base (61)..(61): um
  modified_base (62)..(62): 2' Fluoro Guanosine
  modified_base (63)..(63): um
  modified_base (64)..(64): 2' Fluoro Guanosine
  modified_base (65)..(65): 2'O-Methyl Adenosine
  modified_base (66)..(67): 2'O-Methyl Cytosine
  modified_base (68)..(68): gm
  modified_base (69)..(69): 2'O-Methyl Cytosine
  modified_base (70)..(70): gm
  modified_base (71)..(72): 2'O-Methyl Cytosine
  modified_base (72)..(72): inverted deoxythymidine incorporated at the 3'  end
ccgcgcggaggcuugagguagccguuugucggcuuuuuggcgacgguagauuaugggcagugugaccgcgcc

SEQ ID NO: 441 - RNA, 77 nt, Artificial Sequence
  Aptamer
  modified_base (1)..(2): 2'O-Methyl Cytosine
  misc_feature (1)..(1): The 2'O-Methyl cytosine is attached  through the linker 1,3-propanediolspacer to 2'O-Methyl cytosine of another nucleotide sequence XCCXAC
  modified_base (3)..(3): 2' Fluoro Guanosine
  modified_base (4)..(4): 2'O-Methyl Cytosine
  modified_base (5)..(5): 2'O-Methyl Cytosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(32): gm
  modified_base (33)..(33): 2'O-Methyl Cytosine
  modified_base (34)..(43): 2'O-Methyl deoxyuridine
  misc_feature (34)..(43): 2'O-Methyl deoxyuridine linker
  modified_base (44)..(45): gm
  modified_base (46)..(46): 2'O-Methyl Cytosine
  modified_base (47)..(47): gm
  modified_base (48)..(48): 2'O-Methyl Adenosine
  modified_base (49)..(49): 2'O-Methyl Cytosine
  modified_base (50)..(51): gm
  modified_base (52)..(52): um
  modified_base (53)..(53): 2'O-Methyl Adenosine
  modified_base (54)..(54): gm
  modified_base (55)..(55): 2'O-Methyl Adenosine
  modified_base (56)..(57): um
  modified_base (58)..(58): 2'O-Methyl Adenosine
  modified_base (59)..(59): um
  modified_base (60)..(62): 2' Fluoro Guanosine
  modified_base (63)..(63): 2'O-Methyl Cytosine
  modified_base (64)..(64): 2'O-Methyl Adenosine
  modified_base (65)..(65): 2' Fluoro Guanosine
  modified_base (66)..(66): um
  modified_base (67)..(67): 2' Fluoro Guanosine
  modified_base (68)..(68): um
  modified_base (69)..(69): 2' Fluoro Guanosine
  modified_base (70)..(70): 2'O-Methyl Adenosine
  modified_base (71)..(72): 2'O-Methyl Cytosine
  modified_base (73)..(73): gm
  modified_base (74)..(74): 2'O-Methyl Cytosine
  modified_base (75)..(75): gm
  modified_base (76)..(77): 2'O-Methyl Cytosine
  modified_base (77)..(77): inverted deoxythymidine incorporated at the 3'  end
ccgcgcggaggcuugagguagccguuugucggcuuuuuuuuuuggcgacgguagauuaugggcagugugaccgcgcc

SEQ ID NO: 442 - RNA, 31 nt, Artificial Sequence; identical to SEQ ID NO: 20
  Aptamer
  modified_base (1)..(1): 2'O-Methyl Cytosine
  misc_feature (1)..(1): The 2'O-Methyl cytosine is attached  through the linker 1,3-propanediolspacer to 2'O-Methyl cytosine of SEQ ID NO: 151
  misc_feature (1)..(1): The 2'O-Methyl cytosine is attached  through the linker 1,3-propanediolspacer to 2'O-Methyl cytosine of SEQ ID NO: 151
  modified_base (3)..(3): 2' Fluoro Guanosine
  modified_base (4)..(4): 2'O-Methyl Cytosine
  modified_base (5)..(5): 2' Fluoro Guanosine
  modified_base (6)..(6): 2'O-Methyl Cytosine
  modified_base (7)..(8): 2' Fluoro Guanosine
  modified_base (9)..(9): 2'O-Methyl Adenosine
  modified_base (10)..(11): 2' Fluoro Guanosine
  modified_base (12)..(12): 2'O-Methyl Cytosine
  modified_base (13)..(14): um
  modified_base (15)..(15): 2' Fluoro Guanosine
  modified_base (16)..(16): 2'O-Methyl Adenosine
  modified_base (17)..(18): 2' Fluoro Guanosine
  modified_base (19)..(19): um
  modified_base (20)..(20): 2'O-Methyl Adenosine
  modified_base (21)..(21): 2' Fluoro Guanosine
  modified_base (22)..(23): 2'O-Methyl Cytosine
  modified_base (24)..(24): 2' Fluoro Guanosine
  modified_base (25)..(27): um
  modified_base (28)..(28): gm
  modified_base (29)..(29): um
  modified_base (30)..(30): 2'O-Methyl Cytosine
  modified_base (31)..(31): gm
  modified_base (31)..(31): inverted deoxythymidine incorporated at the 3'  end

SEQ ID NO: 443 - RNA, 16 nt, Artificial Sequence
  Aptamer
  modified_base (1)..(1): 2'O-Methyl Cytosine
  modified_base (2)..(3): 2'O-Methyl Cytosine
  modified_base (4)..(4): 2'O-Methyl Cytosine
  modified_base (5)..(5): 2'O-Methyl Adenosine
  modified_base (6)..(6): 2'O-Methyl Cytosine
  modified_base (7)..(10): 2'O-Methyl Adenosine
  modified_base (11)..(11): 2'O-Methyl Cytosine
  modified_base (12)..(12): 2'O-Methyl Adenosine
  modified_base (13)..(13): 2'O-Methyl Cytosine
  modified_base (14)..(15): 2'O-Methyl Cytosine
  modified_base (16)..(16): 2'O-Methyl Cytosine
gccguguuuucacggc

SEQ ID NO: 444 - RNA, 13 nt, Artificial Sequence
  Aptamer
  modified_base (1)..(6): um
  modified_base (7)..(7): 2'O-Methyl Cytosine
  modified_base (8)..(8): 2'O-Methyl Adenosine
  modified_base (9)..(9): 2' Fluoro Guanosine
  modified_base (10)..(10): 2'O-Methyl Adenosine
  modified_base (11)..(11): 2' Fluoro Guanosine
  modified_base (12)..(12): 2'O-Methyl Adenosine
  modified_base (13)..(13): 2' Fluoro Guanosine
uuuuuucagagag

SEQ ID NO: 445 - RNA, 59 nt, Artificial Sequence
  Aptamer
  modified_base (1)..(1): 2'O-Methyl Adenosine
  modified_base (2)..(3): 2' Fluoro Guanosine
  modified_base (4)..(5): 2'O-Methyl Cytosine
  modified_base (6)..(6): 2' Fluoro Guanosine
  modified_base (7)..(8): 2'O-Methyl Cytosine
  modified_base (9)..(9): um
  modified_base (10)..(11): 2'O-Methyl Cytosine
  modified_base (12)..(12): 2' Fluoro Guanosine
  modified_base (13)..(13): 2'O-Methyl Cytosine
  modified_base (14)..(14): 2' Fluoro Guanosine
  modified_base (15)..(15): 2'O-Methyl Cytosine
  modified_base (16)..(17): 2' Fluoro Guanosine
  modified_base (18)..(18): 2'O-Methyl Adenosine
  modified_base (19)..(22): 2' Fluoro Guanosine
  modified_base (23)..(25): um
  modified_base (26)..(26): 2'O-Methyl Cytosine
  modified_base (27)..(27): 2'O-Methyl Adenosine
  modified_base (28)..(29): um
  modified_base (30)..(30): 2'O-Methyl Adenosine
  modified_base (31)..(31): um
  modified_base (32)..(34): 2'O-Methyl Cytosine
  modified_base (35)..(35): 2' Fluoro Guanosine
  modified_base (36)..(38): um
  modified_base (39)..(40): 2' Fluoro Guanosine
  modified_base (41)..(41): 2'O-Methyl Cytosine
  modified_base (42)..(43): 2' Fluoro Guanosine
  modified_base (44)..(44): 2'O-Methyl Cytosine
  modified_base (45)..(52): um
  misc_feature (45)..(52): 2'O-Methyl deoxyuridine linker
  modified_base (53)..(53): 2'O-Methyl Cytosine
  modified_base (54)..(54): 2'O-Methyl Adenosine
  modified_base (55)..(55): 2' Fluoro Guanosine
  modified_base (56)..(56): 2'O-Methyl Adenosine
  modified_base (57)..(57): 2' Fluoro Guanosine
  modified_base (58)..(58): 2'O-Methyl Adenosine
  modified_base (59)..(59): 2' Fluoro Guanosine
aggccgccuccgcgcggagggguuucauuaucccguuuggcggcuuuuuuuucagagag

SEQ ID NO: 446 - RNA, 85 nt, Artificial Sequence
  Aptamer
  modified_base (1)..(1): 2'O-Methyl Adenosine
  modified_base (2)..(3): 2' Fluoro Guanosine
  modified_base (4)..(5): 2'O-Methyl Cytosine
  modified_base (6)..(6): 2' Fluoro Guanosine
  modified_base (7)..(8): 2'O-Methyl Cytosine
  modified_base (9)..(9): um
  modified_base (10)..(11): 2'O-Methyl Cytosine
  modified_base (12)..(12): 2' Fluoro Guanosine
  modified_base (13)..(13): 2'O-Methyl Cytosine
  modified_base (14)..(14): 2' Fluoro Guanosine
  modified_base (15)..(15): 2'O-Methyl Cytosine
  modified_base (16)..(17): 2' Fluoro Guanosine
  modified_base (18)..(18): 2'O-Methyl Adenosine
  modified_base (19)..(22): 2' Fluoro Guanosine
  modified_base (23)..(25): um
  modified_base (26)..(26): 2'O-Methyl Cytosine
  modified_base (27)..(27): 2'O-Methyl Adenosine
  modified_base (28)..(29): um
  modified_base (30)..(30): 2'O-Methyl Adenosine
  modified_base (31)..(31): um
  modified_base (32)..(34): 2'O-Methyl Cytosine
  modified_base (35)..(35): 2' Fluoro Guanosine
  modified_base (36)..(38): um
  modified_base (39)..(40): 2' Fluoro Guanosine
  modified_base (41)..(41): 2'O-Methyl Cytosine
  modified_base (42)..(43): 2' Fluoro Guanosine
  modified_base (44)..(44): 2'O-Methyl Cytosine
  modified_base (45)..(51): um
  modified_base (52)..(53): 2' Fluoro Guanosine
  modified_base (54)..(54): 2'O-Methyl Cytosine
  modified_base (55)..(55): 2' Fluoro Guanosine
  modified_base (56)..(56): 2'O-Methyl Adenosine
  modified_base (57)..(57): 2'O-Methyl Cytosine
  modified_base (58)..(59): 2' Fluoro Guanosine
  modified_base (60)..(60): um
  modified_base (61)..(61): 2'O-Methyl Adenosine
  modified_base (62)..(62): 2' Fluoro Guanosine
  modified_base (63)..(63): 2'O-Methyl Adenosine
  modified_base (64)..(65): um
  modified_base (66)..(66): 2'O-Methyl Adenosine
  modified_base (67)..(67): um
  modified_base (68)..(70): 2' Fluoro Guanosine
  modified_base (71)..(71): 2'O-Methyl Cytosine
  modified_base (72)..(72): 2'O-Methyl Adenosine
  modified_base (73)..(73): 2' Fluoro Guanosine
  modified_base (74)..(74): um
  modified_base (75)..(75): 2' Fluoro Guanosine
  modified_base (76)..(76): um
  modified_base (77)..(77): 2' Fluoro Guanosine
  modified_base (78)..(78): 2'O-Methyl Adenosine
  modified_base (79)..(82): 2'O-Methyl Cytosine
  modified_base (81)..(81): 2' Fluoro Guanosine
  modified_base (83)..(83): 2' Fluoro Guanosine
  modified_base (84)..(85): 2'O-Methyl Cytosine
aggccgccuccgcgcggagggguuucauuaucccguuuggcggcuuuuuuuggcgacgguagauuaugggcagugugaccgcgcc

SEQ ID NO: 447 - RNA, 10 nt, Artificial Sequence
  linker
uuuuuuuuuu

What is claimed is:

1. A bispecific ribonucleic acid (RNA) aptamer comprising a nucleotide sequence selected from the group consisting of SEQ ID Nos. 69-71 and 74-76.

2. The bispecific RNA aptamer of claim 1, wherein one or more nucleotides of the bispecific RNA aptamer are further chemically modified.

3. The bispecific RNA aptamer of claim 2, wherein the one or more further chemically modified nucleotides are selected from the group consisting of 2'Fluoro (2'F) Guanosine, 2' OMe Guanosine, 2'OMe Adenosine, 2'OMe Cytosine, 2'OMe Uridine and combinations thereof.

4. The bispecific RNA aptamer of claim 1, wherein the bispecific RNA aptamer specifically binds to Vascular Endothelial Growth Factor (VEGF) or an isoform thereof and Interleukin 8 (IL8).

5. The bispecific RNA aptamer of claim 4, wherein the bispecific RNA aptamer inhibits the function of VEGF or an isoform thereof and IL8 by an amount between 90% and 100%.

6. The bispecific RNA aptamer of claim 1, wherein the bispecific RNA aptamer is attached directly to a polyethylene glycol (PEG).

7. The bispecific RNA aptamer of claim 6, wherein the bispecific RNA aptamer has a hydrodynamic radius greater than 10 nm.

8. A pharmaceutical composition comprising the bispecific RNA aptamer of claim 1 and a pharmaceutically acceptable carrier.

9. The pharmaceutical composition of claim 8, formulated for intravitreal administration.

10. A method of treating retinal disease or disorder comprising administering by intravitreal injection an effective amount of the bispecific RNA aptamer of claim 1 to a subject in need thereof, thereby treating the retinal disease or disorder.

11. The method of claim 10, wherein the retinal disease or disorder is selected from the group consisting of the wet form of age-related macular degeneration (wAMD), diabetic retinopathy, diabetic macular edema, retinal vein occlusion, retinopathy of prematurity and radiation retinopathy.

12. The method of claim 10, wherein the subject in need thereof has been previously treated with one or more anti-VEGF agents, but where the subject has shown a suboptimal response to such treatment.

13. A method of treating retinal disease or disorder comprising administering by intravitreal injection an effective amount of the pharmaceutical composition of claim 8 to a subject in need thereof, thereby treating the retinal disease or disorder.

14. The method of claim 13, wherein the retinal disease or disorder is selected from the group consisting of the wet form of age-related macular degeneration (wAMD), diabetic retinopathy, diabetic macular edema, retinal vein occlusion, retinopathy of prematurity and radiation retinopathy.

15. The method of claim 13, wherein the subject in need thereof has been previously treated with one or more anti-VEGF agents, but where the subject has shown a suboptimal response to such treatment.

* * * * *